United States Patent 11,931,406 (FLAVIVIRUS VACCINE) - sequence listing, part 7

SEQ ID NO: 5276 - RNA, 9879 nt, Artificial Sequence
  derived and/or modified CDS sequence (wt) from DENV-1__AB608786__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcuauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugucauaggaacauccaucacccagaaagggauuauuuucauuuuguuaaugcugguaacaccauccuuggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacagaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaagugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuucuuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgcgauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcguccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacauccggaucucccaucgugaacagagaaggaaaaauaguaggucuuuauggaaauggaguagugacaacaaguggaaccuacgucagugccauagcccaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagacgguccagagcguguuauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagcgcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggugaaaggaacaaccagguguuggaggagaacauggacguagagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcucugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccggagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaggaagugggauuauggaaguggacagauccgaagccaaagagggauugaaaagaggagaaacaaccaaacaugcagugucgagaggaaccgcuaaacugaggugguuuguggaaaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagacaucauuggccagaggauagagaacauaaaacaugaacauaagucaacauggcauuaugaugaggacaauccauauaaaacgugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguaa

SEQ ID NO: 5277 - RNA, 9879 nt, Artificial Sequence
  derived and/or modified CDS sequence (wt) from DENV-1__AB608787__SS-prME
ucugugaccaugcuccuuaugcugaugccuacagccuuggcguuccauuugacuacacgagggggagagccgcacaugauagucagcaagcaggaaagaggaaagucacuuuuguucaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggccuugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuacuaacgugugcuaaguucaagugugugacaaaacuggaaggaaagauaguucaauaugaaaacuugaaauauucaguaauagucaccguucacacuggagaccagcaucaggugggaaaugaaagcacagaacaugggacaacugcaacuauaacaccucaagcuccuacgacggaaauacagcugaccgacuacggagcucuuacauuggauuguucaccuagaacaggauuagauuuuaaugaaaugguguuguugacaaugaaagaaaaaucauggcuaguccacaaacaaugguuucuagacuuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcucgaaggauggccauacugggagacaccgcaugggacuuugguucuauaggaggaguguucacgucuguaggaaaauuaguacaccagauuuuuggaacugcauauggaguuuuguucagcgguguuuccuggaccaugaaaauaggaauagggguucugcugacaugguuaggauuaaacucaaggagcacgucccucucgaugacgugcauugcaguuggccuaguaacacuauaccuaggagucaugguucaggcagauucaggaugcguaauaaauuggaaagguagagaacucaaauguggaaguggcauuuuugucaccaaugaaguucacacuuggacagagcaauacaaauuucaagcugacuccccaaaaagacuaucagcagccaucgggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuuggcucaaggaaaaaaaaugauuaggccacaacccauggaacacaaauacucguggaaaagcuggggaaaggcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguauuuggccaaaaucccauacucuauggagcaauggaguucuggaaagugagaugauaauuccaaagaucuauggaggaccaauaucucagcauaacuacagaccaggauauuucacacaaacggcagggccguggcaccuaggcaaguuggaacuggauuucgauuugugugaggguaccacggucguuguggaugaacauuguggaaaucgaggaccaucucuuaggaccacaacagucacaggaaagauaguucaugaaugguguugcagaucuugcacgcuaccacccuuacguuucagaggagaagaugggugcugguacgguauggaaaucagaccagucaaggaaaaggaagagaaucuagucaaaucaauggucucugcagggucaggagaaguggacagcuucucacuaggauugcuaugcauaucaauaauaaucgaagaggugaugagauccagauggauuagaaaaaugcugaugacuggaacacuggguguguucuuccuucucauuaugggucaauugacauggaaugaucugaucagauuaugcaucaugguuggagccaacgcuucugacagaauggggaugggaacgacguaccuagcucugauggccacuuuuaaaaugagaccaauguuugcuguagggcuauuauuccgcagacuaacauccagagaaguucuucuucuaaccauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcauuaugcauggaagacaauggcuaugguacugucaauuguaucucucuuccccuuaugccuguccacgaccucccagaaaacaacauggcuuccggugcuauugggaucucuuggaugcaaaccacuaaccauguuucuuauagcagaaaacaaaaucuggggaaggaaaagcuggccccucaaugaagggaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguucaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagcgucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaagggaaaauaguaggucuuuauggaaauggaguagugacaacaaguggaaccuacgucagugccauagcucaagccaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaagcgcucaagggaaugccaauaagguaccaaacaacagcagugaagagugaacacacaggaaaagagauaguugaccucaugugucacgccacuuucaccaugcgccuccugucucccgugagaguucccaauuacaauaugauuaucauggaugaagcacauuucaccgauccauccagcauagcggccagaggguacaucucaacccgagugggcaugggugaagcagcugcgaucuucaugacagccacucccccaggaucaguggaggccuuuccacagaguaacgcaguuauccaggaugaggaaagagacauuccugagagaucauggaacucaggcuaugaguggaucacugacuucccagguaaaacagucugguuuguuccaagcauuaaagcaggaaaugacauugccaacugcuuaagaaaaaauggaaaacgagugauucaauugagcaggaaaaccuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgcguuauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagauuuggacaaaagaaggagaaagaaagaaauuacgcccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaccuggucauguugcacaacuccgaacaaggaggaagagccuauagacaugcaauggaagaacugccagacaccauagaaacguugaugcuccuagcuuugauagcuguguuaacugguggagugacgcuguucuuccuaucaggaaagggccuagggaaaacaucuauuggccuacucugcgugauggcuucaagcguacugcuauggauggccaguguggagccccauuggauagcggccuccaucauacuggaguucuuccugaugguguugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacuaacgcugacagcagcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacacuuugggagggaucuccaggaaaauuuuggaacaccacgauagcgguuuccauggcaaacauuuucagaggaaguuaucuagcaggagcaggucuggcuuucucauuaaugaaaucucuaggaggagguaggagaggcacgggagcccaaggggaaacacugggagagaaauggaaaagacagcugaaccaacugagcaagucagaauucaacaccuauaaaggaagugggauuauggaaguggacagaucugaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaaccauagaggaaggaagaacgcuacgcguucuaaagaugguggaaccauggcucaaaggaaaccaauuuugcauaaaaauucugaaucccuacaugccaagugugguggaaacucuggagcaaaugcaaagaaaacauggaggaaugcuagugcgaaauccacuuucaagaaauuccacucaugagauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaauauaaaacaugaacauaagucgacauggcauuaugaugaggacaauccauauaaaacaugggccuaucauggaucauaugagguuaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuauggaguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggaacuucacaaacagggaaaaugugccacguguguuuacaacaugauggggaagagagagaaaaaacuaggagaguucggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuucacaaacuuggauauauacucagagacauaucaaagauuccagggggaaacauguaugcagaugacacagccggaugggauacgaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaacuuauggcuuaaacacuuucaccaauauggaagcccagcugauaagacaaauggagucugagggaaucuuuucacccagcgaauuagagaccccaaauuuagccgagagaguucucgacuggcuggaaaaauauggcgucgaaaggcugaaaagaauggcuauuagcggagaugacugcguagugaaaccaauugaugauagguucgcgacagccuuaacagcucugaaugauaugggaaaaguaagaaaagauauaccacaaugggaaccuucaaaaggauggaaugauuggcaacaagugccuuuuuguucacaccacuuccaccagcugauuaugaaagaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaucugagacuggccgcuaaugcuaucuguucagccguuccaguugauuggguuccaaccagccgcaccaccuggucgauccaugcccaucaccaauggaugacaacagaagacaugcugucaguauggaauaggguuuggauagaggaaaacccauggauggaggacaaaacccauauauccaguugggaagauguuccauaucuaggaaaaagggaagaucaaugguguggaucacugauaggcuuaacagcaaggcccaccugggccaccaacauacaaguggccauaaaccaagugagaagacuaauugggaaugagaauuaucuagauuacaugacaucaaugaagagauucaagaacgagagugaacccgaaggggcacucugguga

SEQ ID NO: 5278 - RNA, 9879 nt, Artificial Sequence
  derived and/or modified CDS sequence (wt) from DENV-1__HE795086__SS-prME
ucugugaccaugcuccuuaugcugaugcccacagccuuggcguuccauuugacuacacgggggggagagccgcacaugauagucagcaagcaggaaagaggaaagucacuuuuguuuaagaccucagcaggugucaacaugugcacccuuauagcgauggauuugggagaguuuugugaggacacaaugacuuacaaguguccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcucugaggcacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacacuaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaaucuuugcaggacacuugaaauguagacuaaagauggacaagcugacucugaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuguaccuaggaguuaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaguacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccacuuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguauuuggccaaagucccauacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauaaugauuuuaaaauuauugaccgacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucacuaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaugggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuucugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaaugcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacuccuaugaugaggcacacaaucgaaaacacaacggcaaacauuucccuaacagccauugcaaaccaggcggcuauauugaugggacuugacaaaggauggccaauaucgaagauggacauaggaguuccacuucucgccuuggggugcuauucccaggugaauccacugacgcugacagccgcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaauaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaauaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuggaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuaccgacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccagguuggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcccugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaccaccaauggaugacaacagaagacaugcugucaguguggaauaggguuuggauagaggaaaacccauggauggaggacaaaacccacauauccaguugggaagauguuccauauuuagggaaaagggaagaucaaugguguggaucucugauaggcuuaacagcaagggccaccugggccaccaacauacaaguggccauuaaccaagugagaagacuaauugggaaugagaauuaucuagauuacaugacaucaaugaagagauucaagaacgagagugauccugaaggggcacucugguga

SEQ ID NO: 5279 - RNA, 9879 nt, Artificial Sequence
  derived and/or modified CDS sequence (wt) from DENV-1__AB189120__SS-prME
ucugugaccaugcuccucaugcugcugcccacaguccugacguuccauuugaccacccgagggggagagccucacaugauaguuagcaaacaggaaagaggaaagucacuuuuguuuaagaccucugcaggugucaacaugugcacccuuauugcaauggaccugggagaguuaugugaugacacgaugaccuacaaauguccccggaucacugagacggaaccagaugacguugacuguuggugcaaugccacggagacaugggugaccuauggaacauguucucaaacuggugaacaccgacgagacaaacguuccguugcacuggcaccacacguagggcuuggucuagaaacaagaaccgaaacguggauguccucugaaggcgcuuggagacaaauacaaaaaguggagacaugggcucugagacacccaggauucacggugauagcccuuuuucuagcacaugccauaggaacauccaucacccagaaagggauuauuuucauuuugcugaugcuggugacuccauccauggccaugcggugcgugggaauaggaaacagagacuucguggaaggacugucaggagcuacguggguggauguaguucuggagcauggaaguugcgucacuaccauggcaaaagacaaaccaacacuggacauugaacuccugaagacggaggucacaaacccugccguccugcgcaaacugugcauagaagcuaaaauaucaaauaccaccacugacucgagauguccgacacaaggagaagccacgcugguggaagaacaagacgcgaacuuugugugucgacgaacauucguggacagaggcuggggcaaugguuguggacuauucggaaaagguagcuuaauaacgugugcuaaguuuaagugugugacaaaauuggaaggaaagauaguccaauaugaaaacuuaaaauauucugugaucguuaccguccacacuggagaccagcaccaaguuggaaaugagaccacagaacauggaacaauugcaaccauaacaccucaagcucccacgucggaaauacaacugacagacuacggagcucuaacacuggauuguucaccuagaacagggcuagacuuuaaugagaugguguugcugacaaugaaagaaaaaucauggcucguccacaaacaaugguuucuagacuuaccacugccuuggaccucaggggccucaacgucccaagagacuuggaauagacaagacuugcuggucacauuuaagacagcucaugcaaagaagcaggaagcagucguacuaggaucacaagaaggagcaaugcacacugcguugacuggagcgacagaaauccaaacgucuggaacgacaacaauuuuugcaggccaccugaaaugcagacuaaaaauggacaaacuaacucuaaaaggaauaucauauguaaugugcacaggcucauucaaguuagagaaggaaguggcugagacccagcauggaacuguucuaguacaggucaaauacgaaggaacagaugcaccaugcaagauccccuucucgucccaagaugagaagggaguaacccagaaugggagauugguaacagccaaccccauagucacugacaaagaaaaaccagucaacauugaagcggagccacccuuuggugagagcuacaucgugguaggagcaggugaaaaagcuuugaaacuaagcugguucaagaagggaagcaguauagggaaaauguuugaagcaacugcccguggagcacgaaggauggccauccugggagacaccgcaugggacuucgguucuauaggaggaguguucacgucugugggaaaacugguacaccagaucuuuggaacugcguauggaguuuuguucagcgguguuucuuggaccaugaaaauaggaauagggauucugcugacauggcugggauuaaacucaaggagcacgucccuuucaaugacguguaucgcaguuggcauggucacacuguaccuaggagucaugguccaggcggacucgggauguguaaucaacuggaaaggcagagaacucaaauguggaagcggcauuuuugucacuaaugaaguucacaccuggacagagcaauacaaauuccaggcugacuccccaaagagacuaucagcagccauugggaaggcaugggaggaggggguguguggaauucgaucagccacucgucucgagaacaucauguggaagcaaauaucaaaugaauuaaaccacaucuuacuugaaaaugacaugaaauuuacagugguaguaggagacguuaguggaaucuuggcccaaggaaagaaaacgauuaggccacaacccauggaacacaaauacucguggaaaaguuggggaaaagccaaaaucauuggagcagauguucagaacacuaccuucaucaucgacggcccaaacaccccagaaugccccgaugaccaaagagcauggaacaucugggaaguugaagacuauggauuuggaauuuucacgacaaauauaugguugaaauugcgugauuccuacacccaagugugugaccaucgacuaaugucggcugccaucaaggauagcaaagcaguccaugcugacaugggguacuggauagaaagugaaaagaacgagacuuggaaguuggcaagagccuccuucauagaagucaagacaugcgucuggccaaaaucccacacucuauggagcaauggaguccuggaaagugagaugauaaucccaaagauauauggaggaccaauaucucagcacaauuacagaccaggauauuucacacaaacagcagggccguggcacuuaggcaaguuggaacuagauuuugauuugugugaagguaccacaguuguuguggaugaacauuguggaaaucgcggaccaucucuuagaaccacaacagucacaggaaagauaauccaugaauggugcugcagaucuugcacguuacccccucuacguuucaaaggggaagacgggugcugguacggcauggaaauuagaccagucaaggagaaggaagagaaccuaguuaagucaauggucucugcagggucaggagaaguggacaguuuuucacuaggacuguuaugcauaucaauaaugaucgaagagguaaugagauccagauggagcaggaaaaugcugaugacuggaacauugguuguguuccuccuucucacauugggacaauugacauggaacgaucugaucaggcuaugcaucaugguuggagccaaugcuucagacaauauggggaugggaacaacguacuuagcuuugauggccacuuucagaaugagaccaauguucgcaguagggcuauuauuucgcagauuaacaucuagagaaguucuucuucucacgguuggauugagucugguggcaucuguagaacuaccaaauuccuuagaggagcuaggggauggacuugcaaugggcaucaugauauugaaauuacugacugauuuucaaucacaucagcuaugggccacuuugcugucucuaacauuugucaaaacaacucuuucacugcacuaugcauggaagacaauggccaugauacugucaauuguaucccuccucccuuuaugccuguccacgacuucucaaaaaacgacauggcuuccggugcuucugggaucucuuggaugcaaaccacuaaccauguuucucauaacagaaaacaaaaucuggggaaggaaaaguuggccucucaacgaaggaaucauggcuguuggaauaguuagcauucuacuaagcucacuucucaaaaaugaugugccacuagcuggcccauuaauagcuggaggcaugcuaauagcauguuaugucauauccggaagcucggccgauuuaucacuggagaaagcagcuaaggucuccugggaagaagaagcagaacacucuggcgccucacacaauauacuagucgagauccaagaugauggaaccaugaagauaaaggaugaagagagagaugacacgaucaccauccuccucaaagcaacccugcuggcaaucucagggguguauccaaugucaauaccggcgacucucuuugugugguauuuuuggcagaaaaagaaacagagaucaggaguguuaugggacacacccagcccuccagaaguggaaaaagcaguccuugaugauggcauuuacagaauucuccaaagaggauuguugggcaggucucagguaggaguaggaguuuuccaagaaggcguauuccacacaauguggcacgucaccaggggagcuguucucauguaccaagggaagagauuggaaccaaguugggccagugucaaaaaagacuugauuucauauggaggagguuggagguuucaaggauccuggaacacgggagaagaagugcaggugauugcuguugaaccggggaagaacccaaaaaauguacagacagcgccagguaccuucaagaccucugaaggcgaaguuggagccauagcucuagacuuuaaacccggcacaucuggaucuccuaucgugaacagagagggaaaaauaguaggucuuuauggaaauggaguggugacaacaaguggaaccuaugucagugcuauagcucaagcuaaagcaucacaagaagggccuuugccagagauugaggacgagguguuuaggaaaagaaacuuaacaauaauggaccuacacccaggaucgggaaaaacaagaagauaccuuccagccauaguccgugaggccauaaaaagaaagcugcgcacgcuaguuuuagcucccacaagaguugucgccucugaaauggcagaggcgcucaagggaaugccaauaagguaucagacaacagcagugaagagugaacacacgggaaaggagauaguugaccuuaugugucacgccacuuucacuaugcgucuccuuucuccugugagaguucccaauuauaacaugauaaucauggaugaagcacauuuuaccgauccagccagcauagcagccagaggguacaucucaacccgaguggguaugggugaagcagcugcgauuuucaugacagccaccccccccggaucgguggaggccuuuccacagagcaaugcaguuauccaagaugaggaaaaagacauuccugaaagaucauggaacucaggcuaugacuggaucacugacuucccaggcaaaacagucugguuuguuccaagcaucaaaucaggaaaugacauugccaacuguuuaagaaagaaugguaaacgggugauccaauugagcaggaaaacuuuugacacugaguaucagaaaacaaaaaauaacgacugggacuauguugucacaacagacauauccgaaaugggagcaaacuuucgagcugacaggguaauagacccaaggcggugccugaaaccgguaauacugaaagaugguccagagcgugucauucuagccggaccgaugccagugacuguggcuagugccgcccagaggagaggaagaauuggaaggaaccaaaauaaggaaggugaucaguauauuuacaugggacagccucuaaauaaugaugaggaccacgcccauuggacagaagcaaaaaugcuccuugacaacauaaacacaccagaagggaucaucccagcccucuuugagccggagagagaaaagagugcugcaauagacggggaguacagacuacggggugaagcgaggaaaacguuuguggagcucaugagaagaggagaucuaccugucuggcuaucuuacaaagucgccucagaaggcuuccaauacuccgacagaagguggugcuuugauggggaaaggaacaaccagguguuggaggagaacauggacguggagaucuggacaaaagaaggagaaagaaagaaacugcgaccccgcuggcuggaugccagaacauacucugacccacuggcucugcgcgaauucaaagaguucgcagcaggaagaagaagcgucucaggugaccuaauauuagaaauagggaaacuuccacaacauuuaacgcaaagggcccagaaugcuuuggauaaucugguuaugcugcacaacucugaacaaggaggaaaagcuuauagacacgccauggaagaauugccagacaccauagagacaauaaugcuccuagcuuugauagcugugcugacugguggagugacgcuguucuuccuaucaggaagaggcuuagggaaaacauccauaggccuacucugcgugauguccucaagugcacuguuauggauggccaguguggagccccauuggauagcggccucuauuauacuagaguucuuucugaugguguugcuuauuccagagccagauagacagcgcacuccacaagacaaccaguuagcauauguggugauagguuugcuauucaugauauugacaguggcagccaaugagaugggauuauuggaaaccacaaagaaagaccuggggauuggucaugcagcugcugaaaaccaccaccacgccgcaaugcuggacguagaccuacauccagcuucagccuggacccucuacgcaguggccacaacgauuaucacucccaugaugagacacacaauugaaaacacaacggcaaauauuucccugacagcuauugcaaaccaggcagcuauauugaugggacuugauaagggauggccaauaucaaagauggacauaggaguuccacuucucgccuuggggugcuauucucaggugaacccgcugacgcugacagcggcgguacugaugcuaguagcccauuaugccauaauuggaccaggacugcaagcaaaagccacuagagaagcucaaaaaaggacggcagccggaauaaugaaaaacccaacugucgacgggaucguugcaauagauuuagacccugugguuuaugaugcaaaauuugaaaaacagcuaggccaaauaauguuguugauacuuugcacaucucagauucucuugaugcggaccacaugggccuugugugaauccaucacacuggccacaggaccucugaccacgcuuugggagggaucuccaggaaaauucuggaacaccacgauagcgguguccauggcaaacauuuuuagggggaguuaucuagcaggagcgggucuggccuuuucauuaaugaaaucucugggaggagguaggagagggacgggagcccaaggggaaacacugggagaaaaguggaaaagacagcugaaccaauugagcaagucagaauuuaacacuuacaagaggagugggauuauagaaguggauagaucugaagccaaggagggguugaaaagaggagaaacaaccaaacacgcagugucgagaggaacggccaaacugaggugguuuguggagaggaaccuugugaaaccagaagggaaagucauagaccucgguuguggaagagguggcuggucauauuauugcgcugggcugaagaaagucacagaagugaaaggauacacaaaaggaggaccuggacaugaggaaccgaucccaauggcaaccuauggauggaaccuaguaaagcuacacuccgggaaagauguauucuuuauaccaccugagaaaugugacacucuuuugugugauauuggugaguccucuccgaacccgacuauagaagaaggaagaacguuacguguucuaaagaugguagaaccauggcucagaggaaaucaauuuugcauaaaaauucuaaaucccuauaugccgagugugguagaaacucuggagcaaaugcaaagaaaacauggaggaauguuagugcgaaauccacucucaagaaauuccacucaugaaauguacuggguuucauguggaacaggaaacauugugucagcaguaaauaugacaucuagaaugcugcuaaaucgauucacaauggcucacaggaagccaacauaugaaagagauguggacuugggcgcuggaacgagacauguggcaguagaaccagagguggccaaccuagacaucauuggccagaggauagagaacauaaaaaaugaacacaaaucaacauggcauuaugaugaggauaauccguacaaaacaugggccuaucauggaucauaugaggucaagccaucaggaucagccucauccauggucaaugguguggugagacugcuaaccaaaccaugggaugucauucccauggucacacaaauagccaugacugacaccacacccuuuggacaacaaaggguguuuaaagagaaaguugauacgcguacaccaaaagcgaaacgaggcacagcacaaaucauggaggugacagccaagugguuaugggguuuccucucuagaaacaaaaaacccagaaucugcacaagagaagaguuuacaagaaaagucaggucaaaugcagcuauuggagcaguguucguugaugaaaaucaauggaacucagcaaaagaagcaguggaagaugaaagguucugggaccuugugcgcagagagagggagcuucauaaacaaggaaaaugugccacaugcgucuacaacaugaugggaaagagagagaaaaaauuaggagaguucggaaaggcaaaaggaagucgcgcaauaugguacaugugguugggagcgcgcuucuuagaguuugaagcccuuggcuucaugaaugaagaucacugguucagcagagagaauucacucaguggaguggagggagaaggacuccacaaacuuggauacauacucagagacauaucaaagauuccagggggaaauauguaugcagaugacacagccggaugggacacaagaauaacagaggaugaucuucagaaugaggccaaaaucacugacaucauggaaccugaacaugcccuacuggccacgucaaucuuuaagcuaaccuaccaaaauaagguuguaaggguacagagaccagcaaaaaauggaaccgugauggaugucauauccaggcgugaccagagaggaaguggacagguuggaacuuauggcuuaaacaccuucaccaacauggaggcccaacuaauaagacaaauggagucugagggaaucuuuucacccagcgaauuggaaaccccaaauuuagccggaagaguccuugacugguuggaaaaacauggcaccgagaggcugagaagaauggcaaucaguggagaugacuguguggugaaaccaauugaugacagauuugcaacagccuuaacagccuugaaugacaugggaaagauaagaaaagacauaccgcaaugggaaccuucaaaaggauggaaugauuggcaacaagugcccuucugcucacaccacuuccaccagcugauuaugaaggaugggagggagauaguggugccaugccgcaaccaagaugaacugguagguagggccagagugucacaaggcgccggauggagcuugagagaaacugcaugucuaggcaagucguaugcacaaauguggcagcugauguacuuccacaggagagacuugagacuagcggcuaaugccaucuguucagccguuccaguugauugggucccaaccagucgcaccaccuggucgauccaugcccaccaucaauggaugacaacagaagacauguugucaguguggaauagggucuggauagaggaaaacccauggauggaggauaaaacucauguguccagcugggaagacguuccauaccuagggaaaagggaagaucaaugguguggaucccuaauaggcuuaacagcacgagccaccugggccaccaacauacaaguggccauaaaccaagugagaaggcucauugggaaugagaauuaucuagacuacaugacaucaaugaagagauucaaaaacgagagugaucccgaaggggcacucugguaa

SEQ ID NO: 5280 - RNA, 9879 nt, Artificial Sequence
  derived and/or modified CDS sequence (wt) from DENV-1__AB189121__SS-prME
ucugugaccaugcucuucaugcugcugcccacagcccuggcguuccaucugaccacccgagggggagagccgcacaugauaguuagcaagcaggaaagaggaaagucacuuuuguuuaagaccucugcaggugucaacauguguacccuuauugcaauggauuugggagaguugugugaggacacaaugaccuacaaaugcccccggaucacugaaacagaaccagaugacguugacuguuggugcaacgccacggagacaugggugacuuauggaacauguucucaaacuggugaacaccgacgagacaaacguucuguugcacuggcaccacacguagggcuuggucuagaaacaagaaccgaaacguggauguccucugaaggcgcuuggagacaaauacaaaaaguggagacaugggcucugagacacccaggauucacggugauggcucuuuuucuagcacaugccauaggaacauccaucacccagaaaggaauuauuuucauuuugcugaugcugguaacuccauccauggccaugcggugcgugggaauagguaacagagacuucguggaaggacugucaggagcuacguggguggaugugguacuggagcauggaaguugcgucacuacuauggcaaaagacaaaccaacacuggauauugaacucuuaaagacggaggucacaaacccagccguccugcgcaaacugugcauugaagccaaaauaucaaauaccaccaccgauucgagauguccaacacaaggagaagccacgcugguggaagaacaagacacgaacuuugugugucgacgaacguucguggacagaggcuggggcaaugguugugggcuauuuggaaaagguagcuuaauaacgugugcuaaguuuaagugugugacaaaacuggaaggaaagauaguccaauaugaaaauuuaaaauauucagugauagucaccguccacacuggagaccagcaccaaguuggaaaugagacuacagaacauggaacaacugcaaucauaacaccucaagcuccuacgucggaaauacagcugacagacuacggagcucuaacacuggacuguucaccuagaacagggcuagacuuuaaugagaugguguuauugacaaugaaagaaaaaucauggcucguucacaaacaaugguuucuagacuuaccgcugccuuggaccucgggggcuucaacaucccaagagacuuggaauagacaagacuugcuggucacauuuaagacagcucaugcaaagaagcaggaaguaguuguacuaggaucacaagaaggagcgaugcacacugcgcugacuggagcaacagaaauccaaacgucuggaacgacaacaauuuucgcagggcaccugaaaugcagacugaaaauggauaaacugacuuuaaaagggguaucauauguaaugugcacaggcucauucaagcuagaaaaggaaguggcugagacccagcauggaacuguucuagugcagguuaaguacgaaggaacagaugcaccauguaagauccccuucucaucccaagaugagaagggaguaauccagaaugggagauugauaacagccaaccccauagucacugacaaagaaaaaccagucaacauugaggcggagccaccuuuuggcgagagcuacaucgugguaggagcaggugaaaaagccuugaaacuaagcugguucaagaagggaagcagcauagggaaaauguuugaagcaacugcccguggagcacgaaggauggccauucugggagacacugcaugggacuucgguucuauaggaggaguguucacguccgugggaaaacugguacaccagauuuuuggaacugcguacggaguuuuguucagcgguguuucuuggaccaugaaaauaggaauagggauucugcugacauggcuaggauuaaauucaaggagcacgucccuuucaaugacguguaucgcaguuggcauggucacacuguaccuaggagucaugguucaggcggacucgggauguguaauuaacuggaaaggcagagaacucaaauguggaagcggcauuuuugucacuaaugaaguucacaccuggacagagcaauacaaauuccaggccgacuccccaaagagacuaucagcagccauugggaaggcaugggaggaggguguguguggaauucgaucagccacucgucucgaaaacaucauguggaagcaaauaucaaaugaauuaaaccacaucuuacuugaaaaugacaugaaauucacaguggucguaggagaugucagugggaucuuggcccaaggaaagaaaaugauuaggccacaacccauggaacacaaauacucguggaaaagcuggggaaaagccaagaucauaggagcagauguacagaauaucaccuucaucaucgacggcccaaacaccucagaaugcccugauaaucaaagagcauggaacaucugggaaguugaagacuauggauuuggaauuuucacgacaaacauaugguugaaauugcgugacucuuauacucaagugugugaccaccggcuaaugucagcugccauuaaggauagcaaagcaguccaugcugacaugggguacuggauagaaagugaaaagaacgagacuuggaaguuggcaagagccuccuucauagaaguuaagacaugcaucuggccaaaaucccacacucuauggagcaauggaguccuggaaagugagaugauaaucccaaagauauauggaggaccaguaucucagcacaacuacagaccaggauauuucacacaaacagcagggccauggcacuuaggcaaguuggaacuagauuuugauuugugugaagguaccacaguuguuguggaugaaaauuguggaaaucgaggaccaucucuuagaaccacaacagucacaggaaagacaauccaugaauggugcuguagaucuugcacguuacccccccuacguuucaaaggggaagacgggugcugguacggcauggaaaucagaccagucaaggagaaggaagagaaccuaguuaagucaauggucucugcagggucaggagaaguggauaguuuuucacuaggacugcuaugcauaucaauaaugaucgaagagguaaugagauccagauggagcagaaagaugcugaugacuggaacauuggcuguguuccuccuucucacaaugggacaauugacauggaaugaucugaucaggcuauguaucaugguuggagccaaugcuucagacaugauggggaugggaacaacguaccuagcuuugauggcuacuuucagaaugagaccaauguucgcagucgggcucuuauuucgcagauuaacaucuagagaaguucuucuucuuacaguuggauugagccugguggcaucuguagaacugccaaauuccuuagaagagcuaggggauggacuugcaaugggcaucaugauguugaaauuacugacugauuuucagccacaucagcuaugggcuaccuugcugucuuuaacauuugucaaaacaacuuuuucauugcacuaugcauggaagacaauggccaugauacuaucaauugugucucuccucccuuugugccuguccacgacuucucaaaaaacaacauggcuuccggugcugcugggaucucuuggaugcaaaccacuaaccaugcuucuuauaacagaaaacaaaauuugggggaggagaaguuggccccucaaugaaggaauuauggcuauuggaauaguuagcauccuacuaaguucacuucucaaaaaugaugugccacuagcuggcccacuaauagcuggaggcaugcuaauagcauguuaugucauaucuggaagcucggccgacuuaucacuggagaaagcggcugagguuuccugggaagaugaagcagaacacucuggugccucacacaacauacuaguggagguccaagaugacggaaccaugaagauaaaagaugaagagagagaugacacacucaccauucuccucaaagcaacucuguuagcaaucucagggguauacccaaugucaauaccggcgacccucuuugugugguauuuuuggcagaaaaagaaacagagaucaggagugcuaugggacacacccagcccuccagaaguggaaagagcaguccuugacaauggcauuuauagaauucuccaaagaggauuguugggcaggucucaaguaggaguaggaguuuuucaagaagguguguuccacacaauguggcacgucaccaggggagcuguucucauguaccaagggaagagauuggaaccaaguugggcuagugucaaaagagacuugaucucauauggaggagguuggagguuucaaggauccuggaacacgggagaagaagugcaggugauugcuguugaaccggggaagaaccccaaaaauguacagacaacgccaggcaccuucaagaccccugaaggugaaguuggagcuauagcucuagacuucaaacccggcacaucuggaucuccuaucgugaacagagagggaaaaauagugggucuuuauggaaauggaguggugacaacaaguggaaccuacgucagugccauagcucaagcuaaagcaucacaagaagggccccuaccagagauugaggacgagguguuuaggaaaaggaauuuaacaauaauggaccuacauccaggaucagggaaaacaagaagauaccuuccagccauaguccgugaggccauaaaaagaaagcugcgcacgcuagucuuggcccccacaagaguugucgcuucugaaauggcagaagcgcucaagggaaugccaauaagguaucagacaacagcagugaaaagugaacacacgggaaaggagauaguugaucuuaugugucacgccacuuucacuaugcgucuccugucuccugugagaguccccaauuauaacaugauuaucauggaugaagcacauuucaccgauccagccagcauagcagccagaggguacaucucaacccgaguagguaugggugaagcagcugcgaucuucaugacagccacuccccccggaucgguggaggccuuuccacagagcaaugcaguuauccaagaugaggaaagagacauuccugaaagaucauggaacucaggcuaugaauggaucacugauuucccagguaaaacagucugguuuguuccaagcaucaaaucaggaaaugacauugccaacuguuuaagaaagaaugggaaacgggugguccaauugagcagaaaaacuuuugacacugaguaccagaaaacaaaaaacaacgacugggacuauguugucacaacagacauauccgaaaugggagcaaacuuccgagccgacaggguaauagacccaaggcggugccugaaaccgguaauacuaaaagaugguccagagcgugucauccuagcuggaccgaugccagugacuguggcuagugccgcccagaggagaggaagaauuggaaggaacccaaauaaggaaggugaucaguauguguacaugggacagccucuaaacaaugaugaggaccacgcccauuggacagaagcaaaaaugcuccuugacaacauaaacacaccagaagggaucauuccagcccucuuugagccggagagagaaaagagugcagcaauagacggggaauacagauuacggggugaagcgaggaaaacguucguggagcucaugagaagaggagaucuaccugucuggcuauccuacaaagucgccucagaaggcuuccaguacuccgacagaagguggugcuuugauggggaaaggaacaaccagguguuggaggagaacauggacguggagauuuggacaaaagaaggagaaagaaagaaacuacgaccccgcuggcuggaugccagaacauauucugacccacuggcucugcgcgaauucaaagaguucgcagcaggaagaagaagugucucaggugaccuaauauuagaaauagggaaacuuccacaacauuuaacgcaaaaagcucagaaugcuuuggauaaucugguuaugcugcacaacucugaacaaggaggaaaagccuacagacacgccauggaagaacuaccagauaccauagaaacauuaaugcuccuagcuuugauagcugugcugacugguggagugacguuguucuuccuaucaggaagaggucuaggaaaaacauccauuggccuacucugugugauggccucaagugcacuguuguggauggcuaguguggagccucauuggauagcggccucuaucauacuggaguucuuucugaugguguugcuuauuccagagccagaccgacagcgcacuccacaagacaaccagcuagcauauguggugauagguuuguuauucaugauauugacaguggcagccaaugagaugggauuguuggaaaccacaaagaaagaccuggggauuggucaugcagcugcugaaaaccaccaccaugcugcaaugcuagacguggaccuacauccagcuucagccuggacucucuaugcaguggccacaacaauuaucacucccaugaugagacacacaauugaaaacacaacggcaaauauuucccugacagcuaucgcaaaccaggcagcuauauugaugggacuugacaagggauggccaauaucaaagauggacauaggaguuccacuucucgccuuggggugcuauucucaggugaacccgcugacgcugacagcggcgguauugaugcuaguagcucacuaugccauaauuggaccuggacugcaggcaaaagcuacuagagaagcucaaaaaaggacagcagcuggaauaaugaaaaacccaacuguugacgggaucguugcaauagauuuggacccuguaguuuacgaugcaaaauuugaaaaacagcuaggccaaauaauguuguugauacuuugcacaucacagauucuccuaaugcggaccacaugggccuugugugaauccaucacauuggccacuggaccucugaccacgcuuugggagggaucuccaggaaaauucuggaacacuacuauagcgguguccauggcaaacauuuucaggggaaguuaucuagcaggagcaggucuggccuuuucauugaugaaaucucuaggaggagguaggagaggcacaggagcccaaggagaaacgcugggagaaaaauggaaaagacagcuaaaccaauugagcaaaucagaauuuaacauuuacaagaggagugggauuauagagguggauagaucugaagccaaagagggguugaaaagaggagaaacaaccaaacaugcagugucgagaggaacggccaaauugaggugguuuguggagaggaaccuugugaaaccagaagggaaagucauugaccucgguuguggaagagguggcuggucauauuacugcgcugggcugaagaaagucacagaaguaaaaggauacacgaaaggaggaccuggacaugaggaaccaaucccaauggcaaccuauggauggaaccuaguaaagcuacacuccggaaaagauguauucuuuacaccaccugagaaaugugacacccuuuugugugauaucggugaguccucuccgaacccaacuauagaagaaggaagaacauuacguguucuaaagaugguggaaccauggcucagaggaaaucaauuuugcauaaaaauucuaaaucccuacaugccgagcgugguagaaacucuggagaaaaugcaaaggaaacauggaggaaugcuagugcgaaauccacucucaagaaacuccacucaugaaauguacuggguuucauguggaacaggaaacauugugucagcaguaaacaugacaucuagaaugcugcuaaaccgauucacaauggcucacaggaaaccaacauaugaaagagacguggacuuaggcgcuggaacaagacauguggcaguggaaccagagguggccaaccuagauaucauuggccagaggauagagaauauaaaaaaugaacacaaaucaacauggcauuaugaugaggacaauccauacaaaacaugggccuaucauggaucauaugagguuaagccaucaggaucagccucauccauggucaaugguguggugagacugcuaaccaaaccaugggaugucauucccauggucacacaaauagccaugacugacaccacacccuuuggacaacagaggguguuuaaagagaaaguugauacgcgcacaccaaaagcgaaacgaggcacagcgcaaauuauggagguaacagccaggugguuaugggguuuucucucuagaaacaaaaaacccagaaucugcacaagggaggaguuuacaagaaaaguuaggucaaacgcagcuauuggagcaguguucguugaugaaaaucaauggaacucagcaaaagaggcaguggaagaugaacgguuuugggaccuugugcacagagagagggagcuucauaaacaaggaaaaugugccacgugugucuacaacaugaugggaaagagagagaaaaaauuaggagaguucggaaaggcaaaaggaagucgcgcaauaugguacaugugguugggagcgcgcuuuuuagaguuugaagcccuugguuucaugaaugaagaucauugguucagcagagagaauucacucaguggaguggaaggagaaggacuccacaaacuuggauacauacucagagacauaucaaagauuccagggggaaauauguaugcagaugacacagccggaugggacacaagaauaacagaggaugaucuucagaaugaggcaaaaaucacugacaucauggaaccugaacaugcccuauuggcuacgucaaucuuuaagcuaaccuaccaaaacaagguaguaagggugcagagaccagcaaaaaauggaaccgugauggaugucauauccagacgugaccagagaggaaguggacagguuggaaccuauggcuuaaacaccuucacuaacauggaggcccaacuaauaagacaaauggagucugagggaaucuuuucaccuagcgaauuggaaaccccaaaccuagcugaaagagucuucgacugguuggaaaaacauggcaucgagaggcugaaaagaauggcaaucaguggagaugacuguguggugaaaccaauugaugacagauuugcaacagccuuaacagcuuugaaugacaugggaaagguaagaaaagacauaccgcaaugggaacccucaaaaggauggaacgauuggcaacaagugccuuuuuguucacaccauuuccaccagcugauuaugaaggaugggagggagauaguggugccaugccgcaaccaagaugaacuuguagguagggccagagucucacaaggcgccggauggagcuugagagaaacugcaugccuaggcaagucauaugcacaaauguggcagcugauguacuuccacaggagagauuugagacuagcggcuaaugccaucuguucagccguuccaguugacugggucccaaccagccgcaccaccuggucgauccaugcccaccaucaguggaugacaacagaagacauguugucaguguggaauaggguuuggauagaggaaaacccauggauggaggacaaaacucauguguccaguugggaagacguuccauaccuaggaaaaagggaagaucaaugguguggaucccuaauaggcuuaacagcacgagccaccugggccaccaacauacaaguggccauaaaccaagugagaaggcucauugggaacgagaacuaucuagacuauaugacaucaaugaagagauucaaaaacgagagugaucccgaaggagcacucugguaa

SEQ ID NO: 5281 - RNA, 9879 nt, Artificial Sequence
  derived and/or modified CDS sequence (wt) from DENV-1__AB195673__SS-prME
ucugugaccaugcuccucaugcuacugcccacagcccugacguuccaucugaccacccgagggggagagccgcacaugauaguuggcaagcaggaaagaggaaagucacuuuuguuuaagaccucugcaggugucaacauguguacccuuauugcaauggaucugggagaguuaugugaugacacgaugaccuacaaaugcccccggaucacugagacggaaccagaugacguugacuguuggugcaaugccacggagacaugggugaccuauggaacauguucucaaaccggugaacaccgacgagacaaacguuccguugcacuggcaccacacguagggcuuggucuggaaacaagaaccgaaacguggauguccucugaaggcgcuuggagacaaauacaaaaaguggagacaugggcccugagacacccaggauucacggugauagcccuuuuucuagcacaugucauagggacauccaucacccagaaagggauuauuuucauuuugcugaugcugguaacuccauccauggccaugcggugcgugggaauaggaaacagagacuucguggaaggacugucaggagcuacguggguggauguaguacuggagcauggaaguugugucacuaccauggcaaaagacaaaccaacacuggacauugaacucuugaagacggaggucacaaacccugccgucuugcgcaaacugugcauugaagccaaaauaucaaauaccaccacugauucgagauguccgacacaaggagaagccacguugguggaagaacaagacacgaacuuugugugucgacgaacguucguggacagaggcuggggcaaugguuguggacuauucggaaaagguagcuuaauaacgugugcuaaguuuaagugugugacaaaauuggaaggaaagauaguccaauaugaaaacuuaaaauacucagugaucguuaccguccacacuggagaccagcaccaaguuggaaaugagaccacagaacauggaacaauugcaaccauaacaccucaagcucccacgucggaaauacaacugacagacuacggagcucugacacuggacuguucaccuagaacagggcuagacuuuaaugagaugguguuguugacaaugaaagaaaaaucauggcucguccacaaacaaugguuucuagacuuaccacugccuuggacuucaggggcuucaacaucccaagagacuuggaauagacaagacuugcuggucacauuuaagacagcucaugcaaagaagcaggaaguagucguacuaggaucacaagaaggagcaaugcauacugcguugacuggagcuacagaaauccaaacgucuggaacgacaacaauuuuugcaggccaucugaaaugcagacuaaaaauggacaaacugacucuaaaaggaauaucauauguaaugugcacaggcucauucaaguuagagaaggaaguggcugagacccagcauggaacuguucuaguacagguuaaauacgaaggaacagaugcaccaugcaagauccccuucucgucccaagaugagaagggaguaacccagaaugggagauugguaacggccaaccccauagucacugacaaagaaaaaccagucaauauugaggcggagccaccuuuuggugagaguuacaucgugguaggagcaggagaaaaagcuuugaaacuaagcugguucaagaagggaagcagcauagggaaaauguuugaagcaacugcccguggagcacgaaggauggccaucuugggagacaccgcaugggacuucgguucuauaggaggaguguucacgucugugggaaaacugguacaccagauuuuuggaacugcguauggagucuuguucaguggugucucuuggaccaugaaaauaggaauagggauucugcugacauggcugggauuaaacucaaggagcacgucucuuucaaugacguguaucgcaguugggcugaucacacuguaccuaggagucaugguccaggcggacucgggauguguaaucaacuggaaaggcagagaacucaaauguggaagcggcauuuuugucaccaaugaaguucacaccuggacagagcaauacaaauuucaggccgacuccccaaagagacuaucagcagccauugggaaggcaugggaggaagguguguguggaauucgaucagccacccgucucgagaacaucauguggaagcaaauaucaaaugaauuaaaccacaucuuacuugaaaaugacaugaaauuuacaguggucguaggagacguuaguggaaucuuggcccaaggaaagaaaucgauuaggccacaacccauggaacauaaauacucguggaaaagcuggggaaaagccaaaaucauuggagcagauguucagaacacuacuuucaucaucgacggcccaaacaccccagaaugcccugaugaccaaagagcauggaacaucugggaaguugaagacuauggauuuggaauuuucacgacaaacauaugguugaaauugcgugacuccuacacccaagugugugaccaucgacuaaugucagcugccaucaaggauagcaaagcaguccaugcugacaugggguacuggauagaaagugaaaagaacgagacuuggaaguuggcaagagccuccuucauagaagucaagacaugcaucuggccaaagucucacacucuauggagcaauggaguccuggaaagugagaugauaaucccaaagauauauggaggaccaauaucucagcauaauuacagaccaggauauuucacacaaacagcaggaccguggcacuuaggcaaguuggaacuagauuuugauuugugugaagguaccacaguuguuguagaugaacacuguggaaauagaggaccaucucuuagaaccacaacagucacaggaaagauaauccaugaauggugcuguagaucuugcacguuacccccccuacguuucaaaggagaagacgggugcugguauggcauggaaaucagaccagucaaggagaaggaagagaaccuagucaagucaauggucucugcagggucaggagagguggacaguuuuucacuaggacuguugugcauaucaauaaugaucgaagagguaaugagauccagauggagcaggaaaaugcugaugacuggaacauuggcuguguuccuccuucucacaaugggacaauugacauggaacgaucuaaucaggcuaugcaucaugguuggagccaaugcuucagacaauauggggaugggaacaacguacuuagcuuugauggccacuuucagaaugagaccaauguucgcagucgggcuauuauuucgcagauuaacaucuagagaaguucuucuucucacgguuggauugagucugguggcaucuguagaacuaccaaauuccuuagaggagcuaggggauggacuugcaaugggcaucaugauauuaaaauuacuaacugauuuucaaucacaucagcuaugggccaccuugcugucucugacauuugucaaaacaaccuuuucauugcacuacgcauggaagacaauggcuaugauacugucaauuguaucucucuucccuuuaugccuguccacgacuucucaaaaaacaacauggcuuccggugcuucuggggucucuuggaugcaaaccacuaaccauguuucucauaacagaaaacaaaaucuggggaaggaaaaguuggccucucaaugaaggaaucauggcuguuggaauaguuagcauucuacuaagcucacuucucaaaaaugaugugccacuagcuggcccauuaauagcuggaggcaugcuaauagcguguuaugucauauccggaagcucggccgauuuaucacuggagaaagcggcugaggucuccugggaagaagaagcagaacacucuggugccucacacaacauacuaguggagauccaagaugauggaaccaugaagauaaaagaugaagagagagaugacacgaucaccauccuccucaaagcaaccuugcuagcaaucucagggguauacccaaugucaauaccggcgacucucuuugugugguauuuuuggcagaaaaagaaacagagaucaggagugcuaugggacacaccaagcccuccagaaguggaaagagcaguccuugaugauggcauuuauagaauucuccaaaggggauuguugggcaggucucaaguaggaguaggaguuuuccaagaaggcguauuccacacaauguggcaugucaccaggggagcuguucucauguaccaagggaagagauuggaaccaaguugggccagugucaaaaaagacuugaucucauauggaggaggcuggagguuucaaggauccuggaacacgggagaagaagugcaggugauugcuguugaaccagggaagaacccaaaaaauguacagacagcgccggguaccuucaagaccucugaaggcgaaguuggagccauagcucuagacuuuaaacccggcacaucuggaucuccuaucgugaacagagagggaaaaauaguaggucuuuauggaaauggaguggugacaacaaguggaaccuaugucagugcuauagcucaagcuaaagcaucacaagaagggccuuugccagagauugaggacgagguguuuaggaaaagaaacuuaacaauaauggaccuacacccaggaucgggaaaaacaagaagauaccuuccagccauaguccgugaggccauaaaaagaaagcugcgcacgcuaguuuuagcucccacaaggguugucgccucugaaauggcagaggcgcucaagggaaugccaauaagguaucagacaacagcagugaagagugaacacacgggaagggagauaguugaccuuaugugucacgccacuuucacuaugcgucuccugucuccugugagaguucccaauuacaacaugauaaucauggaugaagcacauuucaccgauccagccagcauagcagccagaggguacaucucaacccgaguggguaugggugaagcagcugcgauuuucaugacagccacuccccccggaucgguggaggccuuuccacagagcaaugcaguuauccaagaugaggagaaagacauuccugaaagaucauggaacucaggcuaugacuggaucacugauuucccagguaaaacagucugguucguuccaagcaucaaaucaggaaaugacauugccaacuguuuaagaaaaaaugggaaacgggugauccaauugagcagaaaaacuuuugacacugaguaccagaaaacgaaaaauaacgacugggacuauguugucacaacagacauuuccgaaaugggagcaaacuuucgagccgacaggguaauagacccaaggcgaugccugaaaccgguaauacugaaagaugguccagagcgugucauucuagccggaccgaugccagugaccguggcuagugccgcccagaggagaggaagaauuggaaggaaccaaaauaaggaaggugaucaguauauuuacaugggacagccuuuaaauaacgaugaggaccacgcccauuggacagaagcaaaaaugcuccuugacaacauaaacacaccagaagggaucaucccagcccucuuugagccagaaagagaaaagagugcugcaauagacggggaauacagacuacggggugaagcgaggaaaacguuuguggagcucaugagaagaggagaucuaccugucuggcuaucuuacaaaguugccucagaaggcuuccaauacuccgacagaagguggugcuuugauggggaaaggaacaaccagguguuggaggagaacauggacguggagaucuggacaaaagaaggagaaagaaagaaacuacgaccccgcuggcuggaugccagaacauacucugacccacuggcucugcgcgaauucaaagaguucgcagcaggaagaagaagcgucucaggugaccuaauauuagaaauagggaaacuuccucaacaucuaacucaaagggcccagaaugcuuuggacaauuugguuaugcugcacaacucugaacaaggaggaaaagcuuauagacacgccauggaagaauugccagacacuauagagacguugaugcuccuagcucugauagcugugcugacugguggagugacgcuguucuuccuaucaggaagaggcuuagggaaaacauccauuggccuacucugcgugauguccucaagugcacuguuauggauggccaguguggagccccauuggauagcggccucuaucauacuggaguucuuucugaugguguugcuuauuccggagccagacagacagcgcacuccacaagacaaccaguuagcauauguggugauaggcuuguuauucaugauauugacaguggcagccaaugagaugggauuauuggaaaccacaaagaaagaccuggggauuggucaugcagcugcugaaaaccaccaccacgccgcaaugcuggacguagaccuacauccagcuucagccuggacucucuacgcaguggccacaacgauuaucacucccaugaugagacacacaauugaaaacacaacggcaaacauuucccugacagccauugcaaaccaggcagcuauauugaugggacuugauaagggauggccaauaucaaagauggacauaggaguuccacuucucgccuuggggugcuauucucaggugaacccgcugacgcugacagcggcgguacugaugcuaguggcucauuaugccauaauuggaccaggacugcaagcaaaagccacuagagaagcucaaaaaagaacagcagccggaauaaugaaaaacccaacugucgacgggaucguugcaauagauuuagacccugugguuuaugaugcaaaauuugaaaaacagcuaggccaaauaauguuguugauacuaugcacaucucagauucucuugaugcggaccacaugggccuugugugaauccaucacacuggccacaggaccucugaccacgcuuugggagggaucuccaggaaaauucuggaacaccacgauagcgguguccauggcaaacauuuuuagggggaguuaucuagcaggagcgggucuggccuuuucauuaaugaaaucucuaggaggagguaggagagggacgggagcccaaggagaaacacugggagaaaaguggaaaagacagcuaaaccaauugagcaagucagaauuuaacauuuacaagaggagugguauuguagagguggauagaucugaagccaaggagggguuaaaaagaggagaaacaaucaaacacgcagugucgagaggaacggccaaacugaggugguuuguggagaggaaccuugugaaaccagaagggaaagucauagaccucggcuguggaagagguggcuggucauauuacugcgcugggcugaagaaagucacagaagugaaaggauacacaaaaggaggaccuggacaugaggaaccaaucccaauggcaaccuauggauggaaccuaguaaagcuauacuccgggaaagauguauucuuuauaccaccugagaaaugugacacccuuuugugugauauuggugaguccucuccgaacccgacuauagaagaaggaagaacguugcguguucuaaagaugguagaaccauggcucagaggaaaccaauuuugcauaaagauucuaaaucccuacaugccgagugugguagaaacucuggagcaaaugcaaagaaaacauggaggaaugcuagugcgaaauccacucucaagaaacuccacucaugaaauguacuggguuucauguggaacaggaaacauugugucagcaguaaauaugacaucuagaaugcugcugaaucgauucacgauggcucacaggaagccaacauaugaaagagauguggacuugggcgcuggaacgagacauguggcaguagaaccagagguggccaaccuagacaucauuggccagaggauagagaauauaaaaaaugaacacaaaucaacauggcauuaugaugaggacaacccguacaaaacaugggccuaucauggaucauaugaggucaagccaucaggaucagccucauccauggucaaugguguggugagacugcuaaccaaaccaugggaugucauucccauggucacacaaauagccaugacugauaccacacccuuuggacaacaaaggguguuuaaagagaaaguugacacgcguacaccaaaagcgaaacgaggcacagcacaaauuauggaggugacagccaagugguuaugggguuuucucuccagaaacaaaaaacccagaaucugcacaagagaggaguucacaagaaaagucaggucaaaugcagcuauuggagcgguguucguugaugaaaaucaauggaacucagcaaaagaggcaguggaagaugaaagguucugggaucuugugcgcagagagagggagcuucauaaacaaggaaaaugugccacgugugucuacaacaugaugggaaagagagagaaaaaauuaggagaguucggaaaggccaaaggaagucgcgcaauaugguauaugugguugggagcgcgcuucuuagaguuugaagcccucggcuucaugaaugaagaucacugguucagcagagagaauucacucaguggaguggaaggagaaggacuccacaaacuuggauacauacucagagacauaucaaagauuccagggggaaacauguaugcagaugauacagccggaugggacacaagaauaacagaggaugaucuucagaaugaggccaaaaucacugacaucauggaaccugaacacgcccuacuggccacgucaaucuuuaaguuaaccuaccaaaacaagguuguaagagugcagagaccagcaaaaaauggaaccgugauggaugucauauccaggcgugaccagagaggaaguggacagguuggaacuuauggcuuaaacaccuucaccaacaugggggcccaacuaauaagacaaauggagucugagggaaucuuuucacccagugaauuggaaaccccaaauuuagcuggaagaguccuugacugguuggaaaaacauggcaucgagaggcugagaagaauggcaaucaguggagaugacugcguggugaaaccaauugaugacagauuugcaacagccuuaacagccuugaaugacaugggaaagguaagaaaagacauaccgcaaugggaaccuucaaaaggauggaaugauuggcaacaagugccuuucugcucacaccacuuccaccagcugauuaugaaggauggaagggaaauaguagugccaugccgcaaccaagaugaacugguagguagggccagaguaucacaaggugccggauggagcuugagagaaacugcaugucuaggcaagucguaugcacaaauguggcagcugauguacuuccacaggagagacuugagauuagcggcuaaugcuauuuguucagccguuccaguugauugggucccaaccagucgcaccaccuggucgauccaugcccaccaucaauggaugacaacagaagacauguugucaguguggaauaggguuuggauagaggaaaacccauggauggaggauaaaacucacguguccagcugggaagacguuccauaccuagggaaaagggaagaucaaugguguggaucccuaauaggcuuaacagcacgagccaccugggccaccaacauacaaguggccauaaaccaagugagaaggcucauugggaaugagaauuaccuagacuacaugacaucaaugaagagauucaaaaacgagagugaucccgaaggggcacucugguaa

SEQ ID NO: 5282 - RNA, 9879 nt, Artificial Sequence
  derived and/or modified CDS sequence (wt) from DENV-1__AB204803__SS-prME
ucugugaccaugcuccucaugcugcugcccacaguccugacguuccaucugaccacccgagggggagagccgcacaugauaguuagcaagcaggaaagaggaaagucacuuuuguuuaagaccucugcaggugucaacaugugcacccuuauugcaauggaucugggagaguuaugugaggacacaaugaccuacaaaugcccucggaucacugaaacggaaccagaugacguugacuguuggugcaaugccacggagacaugggugaccuauggaacauguucucaaacuggugaacaucgacgagacaaacguucugucgcacuagcaccacacguagggcuuggucuagaaacaagaaccgaaacguggauguccucugaaggcgcuuggaaacaaauacaaaaaguggagacaugggcucugagacacccaggauucacggugauagcccuuuuucuagcacaugccauaggaacauccaucacccagaaaggaauuauuuucauuuugcugaugcugguaacuccauccauggccaugcggugcgugggaauaggaaacagagacuucguggaaggauugucaggagcuacguggguggauguggugcuggagcauggaaguugcgucaccaccauggcaaaagacaaaccaacgcuggacauugaacuuuuaaagacggaggucacaaacccugccguccugcgcaaauugugcauugaagcuaaaauaucaaacaccaccacugauucgagauguccaacacaaggagaggccacgcuaguggaagaacaagacacgaacuuugugugucgacgaacguucguggacagaggcugggggaaugguuguggacuauucggaaaaggcagcuuaauaacgugcgucaaguuuaagugugugacaaaauuggaaggaaagauaguccaauaugaaaaccuaaaauauucagugaucguuaccguccacacuggagaccagcaccaaguuggaaaugagaccacagaacauggaacaauugcaaccauaacaccucaagcucccacgucagaaauacagcugacagacuacggagcucuaacacuggauugcucacccagaacagggcuagacuuuaaugagaugguguuguugacaaugaaagaaaaaucauggcucguccacaaacaaugguuucuagacuuaccacugccuuggaccucaggggcuucaacaucccaagagacuuggaauagacaagacuugcuggucacauuuaagacagcucaugcaaagaagcaagaaguagucguacuaggaucacaagaaggagcaaugcauacugcguugacuggagcgacagaaauccaaacgucuggaacgacaacaauuuuugcaggacaucugaaauguagguuaaaaauggauaagcugacuuuaaaaggaacaucauauguaaugugcacaggcccauucaaguuagagaaggaaguggcugagacccagcauggaacuguucuaguacaggucaaauacgaaggaacagaugcaccaugcaagauccccuucucgucccaagaugagaagggaguaacccagaauggaagauugauaacagccaaccccauagucacugacaaagaaaaaccaaucaacauugaggcagagccacccuuuggugagagcuacaucgugguaggaguaggugaaaaagcuuugaaacuaagcugguucaagaagggaagcaguauagggaaaauguuugaagcaacugcccguggagcacgaagaauggccauucugggagacaccgcaugggacuucgguucuauaggaggaguguucacgucuaugggaaaacugguacaccagauuuuuggaacugcuuauggagucuuauucagcgguguuucuuggaccaugaaaauaggaauagggauucugcugacauggcuaggacugaacucaaggagcacgucccuuucaaugacguguaucgcaguaggcauggucacacuguaccuaggagucaugguccaggcggacucgggauguguaaucaauuggaaaggcagagaacucaaauguggaagcggcauuuuugucaccaaugaaguucauaccuggacagagcaauacaaauuccaggccgacuccccaaagagacuaucagcagccauugggaaggcaugggaggaggguguguguggaauucgaucagccacucgucuugagaacaucauguggaagcaaauaucaaaugaauuaaaccacaucuuacuugaaaaugacaugaaauuuacaguagucguuggagacgucagugggaucuuggcccaagggaagaaaaugauuaggccacaacccauggaacacaaauacucguggaaaagcuggggaaaagccaaaaucauaggagcagauguacagaacacuaccuucaucaucgacggcccaaauaccccagaaugcucugaugaccaaagagcauggaacaucugggaaguugaagacuauggauuuggaaucuucacgacaaacauaugguugaaacugcgugacuccuacacccaagugugugaccaccgacuaaugucagcugccaucaaggauagcagagcaguccaugcugacaugggguacuggauagaaagugaaaagaacgagacuuggaaguuggcaagagccuccuucauagaaguuaagacaugcaucuggccaaaaucccacacucuauggagcaauggaguccuggaaagugagaugauaaucccaaagauauauggaggaccaauaucucagcacaauuacagaccaggauacuucacacaaacagcagggccguggcacuuaggcaaguuggaacuggauuuugauuugugugaagguaccacaguugucguggaugaacaauguggaaaucgaggaccaucccuuagaaccacaacagucacaggaaagauaauccaugaauggugcuguagaucuugcacauuacccccccuacgcuucaaaggagaagacgggugcugguacgguauggaaauuagaccagucaaggagaaggaagagaaccuagucaagucaauggucucugcagggucaggagaaguggacaguuuuucacuaggacuguuaugcauaucaauaaugaucgaagagguaaugagauccagauggagcagaaaaaugcugaugacuggaacauuggcuguguuccuccuucucacaaugggacaauuaacauggaaugaucuaaucaggcuauguaucaugguuggagccaaugcuucagacaagauggggaugggaacaacguacuuggcuuugauggccacuuucagaaugagaccaauguucgcaguugggcuauuauuccgcggauuaacauccagagaaguucuccuucucacaguuggauugagcuugguggcaucuguagaacuaccaaauucccuagaggagcuaggggauggacuugcaaugggcauuaugauguuaaaauuacugacugauuuucaaucacaccagcuaugggcuaccuugcugucuuuaacauuugucaaaacaacuuuuucauugcacuaugcauggaagacaauggcuaugacacugucaauuguaucucucuucccuuugugccuguccacgaccucccaaaaaacaacauggcuuccggugcugcugggaucucuuggaugcaaaccauuaaccauguuucucauaacagaaaauaaaaucuggggaaggaaaaguuggccucucaaugaaggaauuauggcuguuggaauaguuagcauccuacuaaguucacuucucaaaaaugaugugccacuagcuggcccauuaauagcuggaggcaugcugauagcauguuaugucauauccggaagcucggcugaucuaucacuggagaaagcggcugaggucucuugggaagaagaagcagaacacucuggugccucacauaacauacuaguagagguccaagaugauggaaccaugaagauaaaggaugaagagagagacgauacaaucaccauccuccucaaagcaacuuugcuagcaaucucagggguauacccaaugucaauaccggcgacucucuuugugugguauuuuuggcagaaaaagaaacagagaucaggagugcuaugggacacacccagcccuccugaaguggaaagagcaguccuugacgaugguauuuauagaauucuccaaagaggauuauugggcaggucucaaguaggaguaggaguuuuucaagaaggcguauuccacacaauguggcacgucaccaggggagcuguccucauguaccaagggaagagauuggaaccaaguugggccagugucaaaaaagaccugaucucauauggaggagguuggagguuucaaggauccuggaacacgggagaagaggugcaggugauugcuguugaaccggggaagaacccaaaaaacguacagacagcgccggguaccuucaagaccucugaaggcgaaguuggagccauagcucuagacuuuaaaccuggcacaucuggaucuccuaucgugaacagagagggaaaaauagugggucuuuauggaaacggagugguuacaacaaguggaaccuaugucagugcaauagcucaagcuaaagcaucacaagaagggccucuaccagagauugaggacgagguguuuaggaaaagaaacuuaacaauaauggaccuacauccaggaucgggaaaaacaagaagauaccuuccagccauaguccgugaggccauaaaaagaaagcugcgcacgcuagucuuagcuccuacaagaguuguugcuucugaaauggcagaggcgcucaagggaaugccaauaagguaccagacaacagcagugaagagugaacacacgggaaaggaaauaguugaccucaugugccacgccacuuucaccaugcgccuccugucuccugugagaguucccaacuacaacaugauuauuauggaugaagcacauuucaccgauccagccagcauagcagccagaggguacaucucaacccgaguggguaugggugaagcagcugcgauuuucaugacagccacuccccccggaucgguggaggccuuuccacagaguaaugcaguuauucaagaugaggaaaaagacauuccugaaagaucauggaacucaggcuaugacuggaucacugacuuuccaggcaaaacagucugguucguuccaagcaucaaaucaggaaaugacaucgcuaacuguuuaagaaagaaugggaaacgggugauccaauugagcagaaaaaccuuugacacugaguaccagaaaacaaaaaacaaugacugggacuauguugucacaacagauauaucugaaaugggagcaaacuuucgagccgacaggguaauagacccaaggcggugucugaaaccaguaauacugaaagauggcccagagcgcgucauucuagccggaccaaugccagugacuguggcuagugccgcccagaggagaggaagaauuggaaggaaccaaaauaaagaaggugaucaguauauuuacaugggacagccccugaacaaugaugaggaccacgcccauuggacagaagcaaaaaugcuacuugacaacauaaacacaccagaagggauuaucccagcccucuuugagccggaaagagaaaagagugcagcaauagacggggaauacagacuacggggcgaagcgaggaaaacauucguggagcucaugagaagaggagaccuaccugucuggcuaucuuacaaaguugccucagaaggcuuccaauacuccgacagaagguggugcuuugauggggaaaggaacaaccagguguuggaggagaacauggauguggagaucuggacaaaagaaggagaaagaaagaaacuacgaccccgcuggcuggacgccagaacauacucugacccacuggcucugcgcgaauucaaagaguucgcagcaggaagaagaagcgucucaggugaucuaauauuagaaauagggaaacuuccacaacauuuaacgcaaaaagcccagacugcuuuggacaaucuggucaugcugcacaacucugaacaaggaggaaaagccuauagacacgccauggaagaacuaccagacaccauagagacguuaaugcuccuagcuuugauagcugugcugacugguggagugacgcuguucuuccuaucaggaaaaggccuagggaaaacauccauuggccuacucugcgugauguccucaagugcacuguuauggauggccaguguggagccccauuggauagcggccucuauuauacuggaguucuuucugaugguguugcuuauuccagagccagauagacagcgcacuccacaagauaaccagcuagcauauguggugauagguuugcuauucaugauauugacaguggcagccaaugagaugggguuauuggaaaccacaaagaaagaccuggggauuggccaugcagcugcugaaaaccaccaccacgcugcaaugcuggacguagaccuacauccagcuucagccuggacucucuacgcaguggccacaacgauuauuacucccaugaugagacauacaaucgaaaacacaacggcgaauauuucccugacagcuauugcaaaccaggcagccauauugaugggacuugauaagggauggccaauaucaaaaauggacauaggaguuccacuucucgcuuuggggugcuauucucaggugaacccgcugacgcugacagcggcgguauugaugcuaguagcucauuaugccauaauuggaccuggacugcaagcaaaagccacaagagaagcucaaaaaaggacagcagccggaauaaugaaaaacccaaccgucgacgggauuguugcaauagauuuagacccugugguuuaugaugcaaaauuugaaaaacagcuaggccaaauaauguuguugauacuuugcacaucucagauucucuugaugcggaccacaugggccuugugugaauccaucacacuggccacaggaccucugaccacgcuuugggagggaucuccaggaaaauucuggaacaccacaauagcgguguccauggcaaacauuuuuagaggaaguuaccuagcaggagcgggucuggccuucucauuaaugaaaucucuaggaggagguaggagaggcacaggagcccaaggggaaacacugggagaaaaauggaaaagacagcuaaaccaacugagcaagucagaauuuaacacuuacaagaggagugggaucauggagguggauagaucugaagccaaagagggguugaaaagaggagagacaaccaaacacgcagugucgagaggaacagccaaacugagaugguucguggagaggaaccuugugaaaccagaaggaaaagucauagaccucgguuguggaagagguggcuggucauauuauugcgcugggcuaaagaaagucacagaagugaaaggauacacaaaaggaggaccuggacaugaggagccaauccccauggcaaccuauggauggaaccuaguaaaguuacauuccgggaaggauguauucuucauaccaccugagaaaugugacacccuuuugugugauauuggugaguccucuccgaacccgaccauagaagaaggaagaacguuacguguucuaaaaaugguggaaccauggcucagaggaaaccaauuuugcauaaaaauuuuaaaucccuacaugccgagugugguagaaacccuggagcaaaugcaaagaaaacauggaggaaugcuagugcgaaauccacucucaagaaauuccacucaugaaauguacuggguuucauguggaacaggaaacauugugucagcaguaaacaugacaucuagaaugcugcuaaaucgauucacaauggcacacaggaaaccaacauaugaaagagauguggacuuaggcgcuggaacaagacauguggcaguagaaccagagguagccaaccuagauaucauuggccagaggauagagaauauaaaaaaugaacacaagucaacauggcauuaugaugaggacaauccguacaaaacaugggccuaucauggaucauaugagguuaggccaucaggaucagccucauccaugguuaaugguguggugagacugcuaaccaaaccaugggauguuauucccauggucacacaaauagccaugacugacaccacacccuuugggcaacagaggguguuuaaagagaaaguugacacacguacaccaaaagcgaaacgaggcacagcacaaauuauggaggugacagccaagugguuaugggguuuccucuccagaaacaaaaaacccagaaucugcacaagagaggaauuuacaaggaaagucaggucaaaugcagcuauuggagcgguguucguugaugaaaaucaauggaacucagcaaaagaggcaguggaagaugaacgguucugggaccuugugcacagagagagggagcuucauaaacaaggaaagugugccacgugugucuacaacaugaugggaaagagagagaaaaaacuaggagaguucggaaaggcaaaaggaagucgcgcaauaugguacaugugguugggagcgcgcuuccuagaguuugaagcccucggcuucaugaaugaagaucacugguucagcagagagaauucacucaguggaguggaaggagaaggacuccacaaacuuggauacauacucagagacauaucaaagauuccagggggaaauauguaugcagaugacacagccggaugggacacaagaauaacagaggaugaucuucagaaugaagccaagaucacugacaucauggaaccugaacaugcccuacuggccacgucaaucuucaagcuaaccuaccaaaacaagguugugagggugcagagaccagcaaaaaguggaacugugauggaugucauauccaggcgugaucagagaggaaguggacagguugggaccuaugguuugaacaccuucaccaacauggaggcccaacuaauaagacaaauggaguccgagggaaucuuuucacccagcgaacuggaaaccccaaaucuagccggaagaguccucgacugguuggaaaaacauggcaucgagaggcugaaaagaauggcaaucagcggagaugacuguguggugaaaccaauugaugacagauuugcaacagcuuuaacagcuuugaaugacauggggaagguaagaaaagacauaccgcaaugggaaccuucaaaaggauggaaugauuggcaacaggugccuuucugcucacaccauuuucaucagcugauuaugaaggaugggagggaaauaguggugccaugccgcagccaagaugaacuuguagguagggccagaguaucgcaaggugccggauggagcuugagagaaacugcaugucuaggcaagucauaugcucaaauguggcagcugauguacuuccacaggagagacuugagauuagcagcuaaugccaucuguucagccguuccaguugauugggucccaaccagccgcaccaccuggucgauccaugcccaccaucaauggaugacuacagaagacauguugucaguguggaauaggguuuggauagaggaaaacccauggauggaggacaaaacucauguguccaguugggaagacguuccauaccuagggaaaagggaagaucaaugguguggaucccuaauaggccuaacagcacgagccaccugggccacuaacauacaaguugccauaaaccaagugagaaggcucaucgggaaugagaauuaucuagacuacaugacaucaaugaagagauucaaaaacgagagugaucccgaaggggcacucugguaa

SEQ ID NO: 5283 - RNA, 9879 nt, Artificial Sequence
  derived and/or modified CDS sequence (wt) from DENV-1__LC016760__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcagguguuaacaugugcacccuuauagcgauggauuugggagaguuaugugaggauacaaugacuuacaaaugcccucgaaucacugaggcggaaccagaugacguugauuguuggugcaaugccacagauacaugggugaccuauggaacauguucccaaacaggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagacguggugcuggaacauggaaguugcgucacuaccauggcaaaagacaaaccaacauuggacauugaacucuugaagacggaagucacaaacccugccguccugcgcaaacugugcauugaagccaaaauaucaaacaccaccaccgacucaagauguccaacacaaggagaagccacacugguggaagaacaagacgcgaacuuugugugucgacgaacguuuguggacagaggcuggggcaauggcugugggcuuuuuggaaaaggaagccuuauaacgugugcuaaguucaagugugugacaaaacuggaaggaaaaauaguucaauaugaaaacuugaaauauucaguaauagucaccguucacacuggagaccagcaccaggugggaaaugaaagcacagaacaugggacaacugcaacuauaacaccucaagcuccuacgacagaaauacagcugaccgacuacggagcucuuacauuggauuguucaccuagaacaggacuagacuucaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcgaagaagcaggaaguagucguacuaggaucacaagaaggagcaaugcacacugcguugaccggagcgacggaaauccaaacgucuggaacgacaacaauuuuugcaggacacuugaaauguagacuaaagauggauaaacugacucuaaaagggaugucauaugugaugugcacaggcucauucaagcuagagaaagaaguggcugagacccaacauggaaccguucuagugcagauuaaauacgaaggaacagaugcaccaugcaagaucccuuuuucgacccaagaugaaaaaggaguaacccagaaugggagauugauaacagccaaccccauagucacugacaaagaaaaaccagucaacauugaggcagaaccgccuuuuggugagaguuacauugugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacaugguuaggauuaaacucaaggagcacgucccuuucgaugacgugcauugcaguuggccuaguaacgcuauacuuaggagucaugguucaggcggauucaggauguguaaucaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuugcuugaaaaugacaugaaauucacagugguuguaggagauguugcugggaucuuggcucaaggaaaaaagaugauuaggccacaacccauggaacacaaauacucguggaaaagcuggggaaaggcuaaaaucauaggggcagaugugcagaacaccaccuuuaucaucgacggcccaaacaccccagaaugcccugaugaucaaagagcauggaacauuugggaaguugaggauuauggauucggaauuuucacgacaaacauauggcugaaauugcgugacuccuacacccaagugugugaccaccggcuaaugucagcugcuaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuauagaccaggauauuucacacaaacggcagggccguggcaccuaggcaaguuggaacuggauuuugauuugugugaggguaccacgguuguuguggaugaacauuguggaaaucgaggaccaucucuuaggaccacaacagucacaggaaagauaauucaugaaugguguugcagaucuuguacgcuaccacccuuacguuacagaggagaagauggguguugguacggaauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacgauagccaugguacugucaauuguaucucucuuccccuuaugccuguccacgaccucccaaaaaacaacauggcuuccggugcuguugggaucucuuggaugcaaaccacuaaccauguuucucauagcagaaaauaaaaucuggggaaggaaaaguuggccccucaaugaaggaauuauggcuguuggaauaguuagcauccuacuaaguucacuccucaaaaaugaugugccgcuagcugggccacuaauagcuggagguaugcuaauagcguguuauguuauaucuggaagcucggccgaucuaucacuagagaaagcggcugaggucuccugggaagaagaagcagaacacucuggcgccucacacaacauauuaguggagguccaagaugacggaaccaugaagauaaaggaugaagagagagaugacacgcuaaccauucuccuuaaagcaacucugcuagcaguuucagggguguacccacuaucaauaccagcgacccuuuuugugugguacuucuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaccaagggaaaagacuggaaccgagcugggcuagugucaaaaaagaccugaucucauauggaggagguuggaggcuucaaggauccuggaacacgggagaagaagugcaggugauugcuguugaaccagggaaaaaccccaaaaauguacaaacagcgccaggcaccuuuaagacuccugaaggcgaaguuggagccauugcccuagauuuuaaacccggcacaucuggaucucccaucgugaacagagaagggaaaauaguaggucuuuauggaaauggaguagugacaacaaguggaaccuaugucagugccauagcucaagccaaagcaucacaagaagggccucuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcuuaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcaggaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaaggaauuaucccagcccucuucgagccggagagagaaaagagugcagcaauagacggggaauacagacugcggggugaagcaaggaaaacguuuguggagcucaugagaagaggagaucuaccugucuggcuaucuuacaaaguugccucagaagguuuccaguacucugauagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguucaaagaguuugcagcaggaagaagaagugucucaggugaucuaauauuggaaauagggaaacuuccacaacacuugacgcaaagggcccagaaugccuuggacaaccugguuauguugcacaacuccgaacaaggaggaagagccuauagacaugcaauggaagaacugccagauaccauagaaacguugaugcuccuagcuuugauagcuguguuaacugguggagugacgcuguucuuccuaucaggaaagggcuuagggaaaacaucuaucggccuacucugcgugauggcuucaagcgugcugcuauggauggccaguguagagccccauuggauagcggcuuccauuauacuggaguucuuccugauggugcugcuuauuccagagccagauagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccuuuaugcaguggccacaacaauuaucacucccaugaugaggcacacaaucgaaaacacaacggcaaacauuucacugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaauaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaaguuacagaagugaagggauacacaaaaggaggaccuggacaugaagaaccagucccaauggcgaccuauggauggaaccuaguaaagcugcacuccgggaaagacguauucuuuauaccaccugagaaaugugacacccucuugugugauaucggugaguccucuccaaacccaacuauagaggaaggaagaacgcuacgcguccuaaagaugguggaaccauggcuuagaggaaaccaauuuugcauaaaaauucugaaucccuacaugcccagugugguggaaacucuggagcaaaugcaaagaaaacauggaggaaugcuggugcgaaauccacucucaagaaauucuacucaugaaauguauuggguuucauguggaacaggaaacauugugucagcaauaaacaugacauccagaauguugcuaaaucgauucacaauggcucacaggaaaccaacauaugaaagagacguggaccuaggcgccggaacaagacauguugcaguggaaccagagguagccaaccuagauaucauuggccagaggauagagaacauaaaaugugaacacaagucaacauggcauuaugaugaggacaauccuuauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaagccaagaauuuguacaagagaggaguucacaagaaaaguuaggucaaacgcagccauuggagcaguguucguugacgaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaauuuggaaaggcaaaaggaagucgugcaauaugguacaugugguugggagcacgcuuucuagaauucgaagcucuugguuucaugaacgaagaucacugguucagcagagagaauucacucagcggaguggaaggagaaggacuccacaaacuuggauacauacuuagagacauaucaaagauuucagggggaaacauguaugcagaugacacagccggaugggauacaaggauaacagaggaugaccuucagaaugaggccaaaauuacugagaucauggaacccgaacaugcccaacuggcuaaggcaaucuucaagcuaaccuaccaaaauaaagugguaaggguacagagaccagcaaaaaauggaaccgugauggaugucauauccagacgugaccagagaggaaguggccaagucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagcccuaacugcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagggcuagagugucacaaggggcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccgcaccaccuggucgauccacgcccaucaccaauggaugacaacagaagacaugcugucaguguggaauaggguuuggauagaggaaaacccauggaugaaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5284 - RNA, 9879 nt, Artificial Sequence
  derived and/or modified CDS sequence (wt) from DENV-1__LC128301__SS-prME
ucugugaccaugcuccucaugcugcugcccacagcccuagcguuucaucugaccacccggggaggagagccgcacaugauaguuagcaagcaggaaagaggaaaaucacuuuuguuuaagaccucugcaggugucaacauguguacccuuauugcaauggauuugggagaguuaugugaggacacaaugaccuacaaaugccccaggaucacugagacggaaccagaugacguugacuguuggugcaaugccacggagacaugggugaccuauggaacauguucucaaacuggugaacaccgacgagacaaacguuccgucgcauuggcaccacacguggggcuuggccuagaaacaagaaccgaaacguggauguccucugaaggcgcuuggagacaaauacaaaaaguggagacuugggcucugagacacccaggauucacggugauagcccuuuuucuagcacaugcuauaggaacauccaucacccagaaaggaauuauuuucauuuugcugaugcugguaacuccauccauggccaugcggugugugggaauaggcaacagagacuucguggaaggacugucaggagcuacguggguggauguggugcuggagcauggaaguugcgucaccaccauggcaaaagacaaaccaacacuggacauugaacuccugaagacggagguuacaaacccugcaguccugcgcaaauugugcauugaagcuaaaauaucaaacaccaccacugauucgagauguccaacacaaggagaagcuacgcuaguggaagagcaggacacgaacuuugugugccgacgaacguucguggacagaggcugggguaaugguugugggcuauucggaaaaggcagcuuaauaacgugugcaaaguucaagugugugacaaaacuggaaggaaagauaguccaauaugaaaaccuaaaauauucagucauagucaccguacacacuggagaccaacaccaaguuggaaaugagaccacagaacauggaacaacugcaaccauaacaccucaagcucccacgucggaaauacagcugacagacuacggagcucuaacauuggauuguucaccuagaacaggacuagacuuuaaugagaugguguuguuaacaaugaaagaaaaaucauggcucguccacaaacaaugguuucuggaccuaccacugccuuggaccucgggggccucaacaucccaagagacuuggaauagacaagacuugcuggucacauuuaagacagcucaugcaaaaaagcaggaaguagucguacuaggaucacaagaaggagcaaugcacacugcgcugacuggagcgacagaaauccaaacgucuggaacgacaacaauuuuugcaggacauuugaaaugcagacuaaaaauggauaaacugaccuuaaaagggguaucauauguaaugugcacagggucauucaagcuagagaaggaaguggcugagacccagcauggaaccguucuagugcagguuaaauacgaaggaacagaugcaccaugcaagauccccuucucgucccaagaugagaagggaguaacccagaaugggagauugauaacagcuaaccccauagucacugacaaagaaaaaccagucaauauugaagcggagccaccuuuuggugagagcuaccucgugguaggagcaggugaaaaagcuuugaaacuaagcugguucaagaagggaaguaguauagggaaaauguuugaagcuacugcccguggagcacgaaggauggccauccugggagacaccgcaugggacuucgguucuauaggagggguguucacgucuguggggaaacugauacaccagauuuuugggacugcguauggagucuuguuuagcgggguuucuuggaccaugaaaauaggaauagggauucugcugacauggcuaggguuaaauucaaggagcacgucccuuucaaugacguguaucgcaguuggcauggucacacuguaccuaggagucaugguucaggcggacucgggaugugugaucaacuggaaaggcagagaacucaaauguggaagcggcauuuuugucaccaacgaaguucacaccuggacagagcaauacaaauuccaggccgacucccccaagagacuaucagcggccauugggaaggcaugggaggaaggugugugugggauccgaucagccacucgucucgagaacaucauguggaagcaaauaucaaaugaauuaaaccacaucuuacuugagaaugacaugaaauuuacagugguuguaggagacguuaauggaaucuuggcccaaggaaagaaaaugauuaggccgcaacccauggaacacaaauacucguggaaaaguuggggaaaagccaaagucauaggagcagauguacagaauaccaccuucaucaucgacggcccaaacaccccagaaugcccugaugaucaaagagcauggaauauuugggaagucgaagacuauggauuuggaauuuucacgacaaauauaugguugaaauugcgugacuccuacacucaagugugugaccaccgacuaaugucagcugccaucaaggauagcaaagcaguccaugcugacaugggguacuggauagaaagugaaaagaacgagacuuggaaguugacaagagccuccuucauagaaguuaagacgugcaucuggccaaaaucccacacccuauggagcaauggagucuuggaaagugagaugauaaucccaaagacguauggaggaccaauaucccagcacaacuacagaccaggauauuucacacaaacagcagggccguggcacuugggcaaguuagaacuggacuuugguuuaugugaagguaccacuguuguuguggaugaacauuguggaaaccgaggaccaucucuuagaaccacaacagucacaggaaagauaauccaugaauggugcuguagaucuugcacguuacccccccuacgcuucaaaggagaagacgggugcugguacgguauggaaaucagaccagucaaggagaaggaagagaacuuagucaggucaauggucucugcagggucaggagaaguggauaguuuuucacuaggacugcuaugcauaucaauaaugaucgaagaggugaugagauccagauggagcagaaaaaugcugaugacuggaacauuggcuguguuccuccuucuuauaaugggacaauugacauggaaugaucugaucaggcuauguaucaugguuggagccaaugcuucagacaagauggggaugggaacaacguaccuagcuuugauggccacuuuuagaaugaggccaauguucgcagucgggcugcuguuucgcagguuaacaucuagagaaguucuucuucucacaguuggauugagucuaguggcaucuguggaacuaccaaauuccuuggaagagcuaggggauggacuugcaaugggcaucaugauguugaaauuacugacugacuuucagucacaucagcuaugggcugccuugcugucuuuaacauuugucaaaacaacuuuuucacugcacuaugcauggaagacaauggcuaugauacugucaaucauaucucucuucccuuuaugcauguccacgacuucucaaaaaacaacauggcuucccguguugcugggaucucuuggaugcaaaccacuaacuauguuucuuauuacagaaaacaaaaucuggggaagaaaaagcuggccucucaaugagggaauuauggcuguugggauaguuagcauucuucuaaguucacuucucaaaaaugauguaccacuagcuggcccacuaauagcuggaggcaugcugauagcauguuaugucauaucuggaagcucggccgauuuaucacuggagaaagcagcugagguuuccugggaagaagaagcagaacacucuggugccucacacaacauacuaguggagguccaagaugauggaacuaugaagauaaaagaugaagagagagaugacacacuuaccauucuccucaaagcaacuuugcuagcaaucucagggguauacccaaugucaauaccggcuacccucuuugugugguauuuuuggcagaaaaagaaacagagaucaggagugcuaugggacacacccagcccuccagaaguggaaagagcaguccuugaugauggcauuuauagaauucuccaaagaggauuauugggcaagucucaaguaggaguaggaguuuuccaagaagguguguuccacacaauguggcacgucaccaggggagcuguccucauguaccaagggaagagauuggaaccaaguugggccagugucaaaaaagacuugaucucauauggaggaggcuggagguuucaaggauccuggaacacgggagaagaagugcaggugauugcuguugaaccggggaagaacccuaaaaauguacagacagcgccaggcaccuuuaagaccccugaaggugaaguuggagccauagcucuagauuuuaaacccggcacaucuggaucuccuauugugaacagagaggggaaaauaguaggucuuuauggaaauggaguggugacaacaagcggaaccuacgucagugccauagcucaagccaaagcaucacaagaagggccucuaccagagauugaggacgagguguuuaggaaaagaaacuugacaauaauggaccuacauccaggaucaggaaaaacaagaagauaccuuccagccauaguccgugaagcuauaaaaagaaagcuacgcacacuagucuuggcucccacaagaguugucgccucugaaauggcagaggcgcucaagggaaugccaauaagguaccagacaacagcagugaaaagugaacacacgggaaaagagauaguugaccucaugugucacgcuaccuuuaccaugcgucuccucucuccugugagaguucccaauuauaauaugauuaucauggaugaagcacauuucacugauccagccagcauagcagccagaggguacaucucaacccgaguggguaugggugaagcagcugcaauuuucaugacagccacuccccccggaucgauggaggccuuuccacagagcaaugcagcuauccaagaugaagagagagauauuccugaaaggucuuggaacucaggcuaugacuggauuacugauuucccagguaaaacaguuugguuuguuccaagcaucaaaucaggaaaugacauugccaacuguuuaagaaagaaugggaaacgggugguccaauugagcaggaaaaccuuugacacugaguaccagaagacaaaaaauaacgacugggacuauguugucacaacagacauaucugaaaugggagcaaacuuccgagcugacaggguaauagacccaagacggugccuaaaaccgguaauacugaaagaugguccagagcgugucauucuagccggaccgaugccagugacuguggcuagcgccgcccagaggagaggaagaauuggaaggaaccaaaauaaggaaggagaccaguauauuuacaugggacagccucuaaacaaugaugaggaccaugcccauuggacagaagcaaaaaugcuccuugacaacauaaacacaccagaagggauuaucccagcccucuuugagccggagagagaaaagagugcagcaauagacggggaauacagacuacggggugaagcgaggaaaaccuucguagagcuuaugagaagaggagaucuaccugucuggcuauccuacaaaguugccucagaaggcuuccaguacuccgacagaagguggugcuuugauggagaaaggaacaaccaggugcuggaggagaacauggacguggagaucuggacaaaagaaggagaaagaaagaaacuacgaccccgcuggcuggaugccagaacauacucugacccacuggcucugcgugaauucaaagaguucgcagcaggaagaagaagcguuucaggugaccuaauauuagaaauagggaaacuuccacaacaucuaacgcaaagggcccagaaugcccuggacaaccugguuaugcugcacaauucugagcagggaggaaaagccuauagacacgccauggaagaacuaccagacacuauagaaacguugaugcuucuggcuuugauagcuguguugacugguggggugacguuguucuuccuaucaggaaggggucuaggaaaaacauccauuggucuacucugcgugauggccucaagugcacuguuauggauggccaguguggaaccccauuggauagcggccucuaucauacuggaguucuuucugaugguguugcuuauuccagaaccggacagacagcgcacuccacaagacaaccagcuagcauacguggugauaggucuauuauucaugauauugacaguggcagccaaugagaugggauuacuggaaaccacaaagaaggaccuagggauuggccauguagcugcugaaagccaccaccaugcugcaaugcuggacguagaccuacauccagcuucagccuggacccucuacgcaguggccacaacaauuaucacucccaugaugagacacacaauugaaaacacaacggcaaacauuucccugacagcuaucgcaaaccaggcagcuauauugaugggacuugacaagggauggccaauaucaaagauggacauaggaguuccccuucuugcccuggggugcuauucucagguaaacccgcugacgcugacagcggcgguguugaugcuaguggcucauuaugccauaauuggacccggacugcaagcaaaagcuacuagggaagcucaaaaaaggacagcagcuggaauaaugaaaaacccaacugucgaugggaucguugcaauagauuuggacccugugguuuacgaugcaaaauuugaaaaacagcuaggccaaauaaugcuguugauacuuugcacaucacagauucuucugaugcggaccacaugggccuugugugaauccaucacacuagccacuggaccucugacuacacucugggagggaucuccaggaaaauucuggaacaccacgauagcgguguccauggcaaacauuuuuaggggaagcuaucuagcaggagcaggucuggcuuuuucauuaaugaaaucucuaggaggagguaggagaggcacgggagcccaaggggaaacacugggagaaaaauggaaaagacagcuaaaccaauugagcaagucagaauucaacacuuacaaaaggagugggaucauggagguggauagaucugaagccaaagagggguuaaaaagaggagaaacgacuaaacacgcagugucgagaggaacggccaaacugaggugguuuguagagaggaaccuugugaaaccagaagggaaagucauagaccucgguuguggaagagguggcuggucauauuauugcgcugggcugaagaaagucacagaagugaaaggauauacgaaaggaggaccugggcaugaggaaccaauuccaauggcaaccuauggauggaaccuaguaaaacuauacuccgggaaggauguauucuuuacaccaccugagaaaugugacacccucuugugcgacauuggugaguccucuccgaacccaaccauagaagaaggaagaacguuacguguccuaaagaugguggaaccauggcucagaggaaaccaauucugcauaaaaguucuaaaucccuacaugccgagcgugguagaaacuuuggagcaaaugcaaagaaaacauggaggaaugcuagugcgaaauccacucucaagaaacuccacucaugaaauguauuggguuucauguggaacaggaaacauugugucagcaguaaacaugacaucuagaaugcugcuaaaccgauucacaaugacucacaggaagccaacauaugaaaaagacguggacuuaggcgcuggaacaagacauguggcaguagaaccagagguggccaaccuagauaucauuggccagaggauagaaaauauaaaaaaugaacacaaaucaacauggcauuaugaugaggauaauccauacaaaacaugggccuaucauggaucauaugaagucaagccaucaggaucagcuucauccaugguuaaugguguggugagacugcugaccaaaccaugggaugucauccccauggucacacaaauagccaugacugacacuacaccuuuuggacaacagaggguguucaaagagaaaguugacacgcgcacaccaaaagcgaaacgaggcacagcacaaauuauggaagugacagcuaggugguuauggggguuucucucuagaaacaaaaaacccagaaucugcacaagagaggaguucacaagaaaaguuaggucaaacgcagcuauuggagcaguguucguugaugaaaaucaauggaacucagcaaaagaggcaguggaggaugaacgguucugggaccuugugcacagagagagggagcuucauaaacaaggaaaaugugccacgugugucuacaacaugaugggaaagagagagaaaaaauuaggagaguucggaaaggcaaaaggaagucgugcaauaugguacaugugguugggagcucgcuucuuagaguuugaagcccuugguuucaugaaugaagaucacugguucagcagagagaauucacucaguggaguggagggagaaggacuccacaaacuuggauacauacucagagacauaucaaagauuccagggggaaauauguaugcagaugacacagccggaugggacacaagaauaacagaggaugaucuucagaaugaggccaaaaucacugacaucauggaaccugaacaugcccuacuggccacgucaaucuuuaagcuaaccuaccaaaacaaaguaguaagggugcagagaccagcaaaaaauggaaccgugauggaugucauauccagacgugaccagagaggaaguggacagguuggaaccuauggcuuaaacaccuucaccaacauggaggcccaacuaauaagacaaauggagucugagggaaucuuuuuacccagcgaacuggaaaccccaaaucuagcugaaagaguccuugacugguuggaaaaacauggcacugagaggcugaaaagaauggcaauuaguggagaugacuguguggugaaaccaauugaugacagauucgcaacagccuuaacagcucugaaugacauggggaagguaagaaaagacauaccacaaugggaaccuucaaaaggauggaaugauuggcaacaagugccuuucuguucacaccauuuccaccagcugaucaugaaggaugggagagagauaguggugccaugccgcaaccaagaugaacuuguggguagggccagaguaucacaaggcgccggauggagccugagagaaacugcaugccuaggcaagucauaugcacaaauguggcagcugauguacuuccacaggagagacuugagauuagcggcuaaugcuaucuguucagccguuccgguugauugggucccaaccagccgcaccaccuggucgauccaugcccaccaccaauggaugacaacagaagacauguugucaguguggaauaggguuuggauagaggaaaacccauggauggaggacaaaacucauguguccaguugggaagacguuccauaccuaggaaaaagggaggaucaaugguguggaucccuaauaggcuuaacagcacgagccaccugggccaccaacauacaaguggccauaaaccaagugagaaggcucauugggaaugagaauuaucuagacuacaugacaucaaugaagagauucaagaacgagagugauccugaaggggcacucugguaa

SEQ ID NO: 5285 - RNA, 9879 nt, Artificial Sequence
  derived and/or modified CDS sequence (wt) from DENV-1__LC011945__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcagguguuaacaugugcacccuuauagcgauggauuugggagaguuaugugaggauacaaugacuuacaaaugcccucgaaucacugaggcggaaccagaugacguugauuguuggugcaaugccacagauacaugggugaccuauggaacauguucccaaacaggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagacguggugcuggaacauggaaguugcgucacuaccauggcaaaagacaaaccaacauuggacauugaacucuugaagacggaagucacaaacccugccguccugcgcaaacugugcauugaagccaaaauaucaaacaccaccaccgacucaagauguccaacacaaggagaagccacacugguggaagaacaagacgcgaacuuugugugucgacgaacguuuguggacagaggcuggggcaauggcugugggcuuuuuggaaaaggaagccuuauaacgugugcuaaguucaagugugugacaaaacuggaaggaaaaauaguucaauaugaaaacuugaaauauucaguaauagucaccguucacacuggagaccagcaccaggugggaaaugaaagcacagaacaugggacaacugcaacuauaacaccucaagcuccuacgacagaaauacagcugaccgacuacggagcucuuacauuggauuguucaccuagaacaggacuagacuucaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcgaagaagcaggaaguagucguacuaggaucacaagaaggagcaaugcacacugcguugaccggagcgacggaaauccaaacgucuggaacgacaacaauuuuugcaggacacuugaaauguagacuaaagauggauaaacugacucuaaaagggaugucauaugugaugugcacaggcucauucaagcuagagaaagaaguggcugagacccaacauggaaccguucuagugcagauuaaauacgaaggaacagaugcaccaugcaagaucccuuuuucgacccaagaugaaaaaggaguaacccagaaugggagauugauaacagccaaccccauagucacugacaaagaaaaaccagucaacauugaggcagaaccgccuuuuggugagaguuacauugugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacaugguuaggauuaaacucaaggagcacgucccuuucgaugacgugcauugcaguuggccuaguaacgcuauacuuaggagucaugguucaggcggauucaggauguguaaucaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuugcuugaaaaugacaugaaauucacagugguuguaggagauguugcugggaucuuggcucaaggaaaaaagaugauuaggccacaacccauggaacacaaauacucguggaaaagcuggggaaaggcuaaaaucauaggggcagaugugcagaacaccaccuuuaucaucgacggcccaaacaccccagaaugcccugaugaucaaagagcauggaacauuugggaaguugaggauuauggauucggaauuuucacgacaaacauauggcugaaauugcgugacuccuacacccaagugugugaccaccggcuaaugucagcugcuaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuauagaccaggauauuucacacaaacggcagggccguggcaccuaggcaaguuggaacuggauuuugauuugugugaggguaccacgguuguuguggaugaacauuguggaaaucgaggaccaucucuuaggaccacaacagucacaggaaagauaauucaugaaugguguugcagaucuuguacgcuaccacccuuacguuacagaggagaagauggguguugguacggaauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacgauagccaugguacugucaauuguaucucucuuccccuuaugccuguccacgaccucccaaaaaacaacauggcuuccggugcuguugggaucucuuggaugcaaaccacuaaccauguuucucauagcagaaaauaaaaucuggggaaggaaaaguuggccccucaaugaaggaauuauggcuguuggaauaguuagcauccuacuaaguucacuccucaaaaaugaugugccgcuagcugggccacuaauagcuggagguaugcuaauagcguguuauguuauaucuggaagcucggccgaucuaucacuagagaaagcggcugaggucuccugggaagaagaagcagaacacucuggcgccucacacaacauauuaguggagguccaagaugacggaaccaugaagauaaaggaugaagagagagaugacacgcuaaccauucuccuuaaagcaacucugcuagcaguuucagggguguacccacuaucaauaccagcgacccuuuuugugugguacuucuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaccaagggaaaagacuggaaccgagcugggcuagugucaaaaaagaccugaucucauauggaggagguuggaggcuucaaggauccuggaacacgggagaagaagugcaggugauugcuguugaaccagggaaaaaccccaaaaauguacaaacagcgccaggcaccuuuaagacuccugaaggcgaaguuggagccauugcccuagauuuuaaacccggcacaucuggaucucccaucgugaacagagaagggaaaauaguaggucuuuauggaaauggaguagugacaacaaguggaaccuaugucagugccauagcucaagccaaagcaucacaagaagggccucuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcuuaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcaggaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguucagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaaggaauuaucccagcccucuucgagccggagagagaaaagagugcagcaauagacggggaauacagacugcggggugaagcaaggaaaacguuuguggagcucaugagaagaggagaucuaccugucuggcuaucuuacaaaguugccucagaagguuuccaguacucugauagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguucaaagaguuugcagcaggaagaagaagugucucaggugaucuaauauuggaaauagggaaacuuccacaacacuugacgcaaagggcccagaaugccuuggacaaccugguuauguugcacaacuccgaacaaggaggaagagccuauagacaugcaauggaagaacugccagauaccauagaaacguugaugcuccuagcuuugauagcuguguuaacugguggagugacgcuguucuuccuaucaggaaagggcuuagggaaaacaucuaucggccuacucugcgugauggcuucaagcgugcugcuauggauggccaguguagagccccauuggauagcggcuuccaucauacuggaguucuuccugauggugcugcuuauuccagagccagauagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccuuuaugcaguggccacaacaauuaucacucccaugaugaggcacacaaucgaaaacacaacggcaaacauuucacugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaauaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaaguuacagaagugaagggauacacaaaaggaggaccuggacaugaagaaccagucccaauggcgaccuauggauggaaccuaguaaagcugcacuccgggaaagacguauucuuuauaccaccugagaaaugugacacccucuugugugauaucggugaguccucuccaaacccaacuauagaggaaggaagaacgcuacgcguccuaaagaugguggaaccauggcuuagaggaaaccaauuuugcauaaaaauucugaaucccuacaugcccagugugguggaaacucuggagcaaaugcaaagaaaacauggaggaaugcuggugcgaaauccacucucaagaaauucuacucaugaaauguauuggguuucauguggaacaggaaacauugugucagcaauaaacaugacauccagaauguugcuaaaucgauucacaauggcucacaggaaaccaacauaugaaagagacguggaccuaggcgccggaacaagacauguugcaguggaaccagagguagccaaccuagauaucauuggccagaggauagagaacauaaaaugugaacacaagucaacauggcauuaugaugaggacaauccuuauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaagccaagaauuuguacaagagaggaguucacaagaaaaguuaggucaaacgcagccauuggagcaguguucguugacgaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaauuuggaaaggcaaaaggaagucgugcaauaugguacaugugguugggagcacgcuuucuagaauucgaagcucuugguuucaugaacgaagaucacugguucagcagagagaauucacucagcggaguggaaggagaaggacuccacaaacuuggauacauacuuagagacauaucaaagauuucagggggaaacauguaugcagaugacacagccggaugggauacaaggauaacagaggaugaccuucagaaugaggccaaaauuacugagaucauggaacccgaacaugcccaacuggcuaaggcaaucuucaagcuaaccuaccaaaauaaagugguaaggguacagagaccagcaaaaaauggaaccgugauggaugucauauccagacgugaccagagaggaaguggccaagucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagcccuaacugcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagggcuagagugucacaaggggcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccgcaccaccuggucgauccacgcccaucaccaauggaugacaacagaagacaugcugucaguguggaauaggguuuggauagaggaaaacccauggaugaaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5286 - RNA, 9879 nt, Artificial Sequence
  derived and/or modified CDS sequence (wt) from DENV-1__LC011949__SS-prME
uccgugaccaugcuccuuaugcuggugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugcuacagacacaugggugaccuauggaacauguucccaaacuggcgagcaccgacgagacaaacguuccgucgcacuagccccacacgugggacuugguuuggaaacaagaaccgaaacguggauguccuccgaaggcgcuuggaaacagauacaaagaguggagacuugggcccugagacacccaggauucacggugauagcccucuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugcuguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaaugguugugggcucuucggaaaaggaagccuuauaacgugugcuaaauucaagugugugacaaaacuggaaggaaaaauaguucaauaugaaaacuugaaauauucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaagucauggcuaguccacaaacaaugguuucuagaccuaccacugccuuggaccucgggagcuucaacaucacaagaaacuuggaacagacaagauuugcuggugacauuuaagacagcccaugcaaagaagcaggaaguagucguacuaggaucacaagaaggagcaaugcacacugcguugaccggagcgacagaaauccaaacgucuggaacaacaacaauuuuugcaggacacuugaaauguagacuaaagauggacaaacugacucuaaaagggacgucauacgugaugugcacaggcucauucaagcuagagaaagaaguggcugagacccagcacggaaccguucuagugcagauuaaauacgaaggaacagaugcaccaugcaagauccccuuuucgacccaagaugaaaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacugagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucacuuucgaugacgugcauugcaguuggccuaguaacgcuauacuuaggagucaugguucaggcggacacaggauguguaauuaauuggaaagguagagaacucaaauguggaaguggcauuuuugucaccaaugaaguucacacuuggacagagcaauacaaauuucaagcugauuccccaaagagacuaucagcagccauugggaaagcaugggaggaggguguguguggaauucgaucagcaacucgucucgagaacaucauguggaagcaaauaucaaaugaauugaaccacaucuuacuugaaaaugacaugaaauucacagugguuguaggagauguugccgggaucuuggcucaaggaaaaaaaaugauuaggccacaacccauggaauauaaauacucguggaaaagcuggggaaaggcuaaaaucauaggggcagauguacagaacaccaccuucaucaucgacggcccaaacaccccagaaugcccugaugaucaaagagcguggaacauuugggaaguugaggauuauggauuuggaauuuucacgacaaacauauggcugaaauugcgugacuccuacacccaagugugugaccaucggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacggcauggaaaucagaccagucaaggaaaaggaagagaaucuagucaaaucaaugguuucugcagggucaggggaaguggauagcuuuucacuaggacuacuaugcauaucaauaaugaucgaagaggugaugagauccagauggaguagaaaaaugcugaugacuggaacacuggcuguguucuuccuucucauaaugggacaacugacauggaaugaucugaucagauuaugcaucauggucggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauucccuggaggagcugggggauggacuugcaaugggcauuaugauuuuaaaauuauugacugacuuucaaucacaucagcugugggcuaccuugcuguccuugacauuuaucaaaacaacguuuuccuuacacuaugcauggaagacaauggcuaugguacugucaauuguaucucucuuccccuuaugccuguccacgaccucccaaaaaacaacauggcuuccggugcuauuggggucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauuucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggcgaaguuggagccauugcccuagacuuuaaacccggcacaucuggaucuccuaucgugaacagagaagggaaaauaguaggucuuuauggaaauggaguagugacaacaaguggaaccuacguuagugccauagcucaagcuaaagcaucacaagaagggccccuaccagagauugaagaugagguguuuaagaaaagaaacuuaacaauaauggaccuacauccaggaucggggaaaacaagaagauaccuuccagccauaguccgugaagccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgucuccugucucccgugagaguucccaauuacaacaugauuaucauggaugaagcacauuucaccgauccgucuagcauagcggcuagaggguacaucucaacccgagugggcaugggugaagcagcugcgaucuucaugacagccacucccccaggaucaguggaggccuucccacagagcaacgcaguuauccaagaugaggaaagagacauuccugagaggucauggaacucaggcuacgaguggaucacugacuucccaggcaaaacaguuugguuuguuccaagcauuaaaucaggaaaugauauugccaacugcuuaagaaagaauggaaaacgggugauccaauugagcaggaaaaccuuugacacagaguaccaaaaaacaaaaaauaaugacugggacuacgucgucacaacagacaucucagagaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggaucaucccagcccucuucgagccggagagagaaaagagugcagcaauagacggggaauacagacugcggggugaagcaaggaaaacguuuguggagcucaugagaagaggagauuuaccugucuggcuauccuacaaaguugccucagaaggcuuucaguacucugauagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcaucucaggugaucuaauauuagaaauagggaaacuuccacaacacuugacgcaaagggcccagaaugccuuggacaaccugguuauguugcacaacuccgaacaaggaggaagagccuauagacaugcaauggaagagcugccagacaccauagaaacgcugaugcuccuagcuuugauagcuguguuaacugguggagugacgcuguucuuccuaucaggaaggggccuagggaaaacauccaucggccuacucugcgugauggcuucaagcguacugcuauggauggccaguguagagccccauuggauagcggccuccaucauacuggaguucuuccugauggugcugcuuauuccagaaccagacagacaacgcacuccgcaggacaaccagcuggcauauguggugauagguuuguuauucaugauacugacaguagcagccaaugagaugggacugcuggaaaccacaaagaaagacuuagggauuggccauguggcugucgaaaaucaccaccaugccgcaaugcuggacguagaccuacauccagcuucagccuggacccucuaugcaguggccacaacaauuaucacucccaugaugaggcacacaaucgaaaacacaacggcaaacauuucccugacagccaucgcaaaccaggcagcuauauugaugggacuugauaaaggauggccaauaucaaagauggacauaggaguuccacuucucgccuuggggugcuauucccaggugaauccacugacgcugacagcggcgguauugaugcuaguggcucauuacgcuauaauuggaccuggacugcaagcaaaagccacuagagaagcucaaaaaaggacagcggccggaauaaugaaaaauccaaccguugauggaaucguugcaauagauuuggacccugugguuuaugaugcgaaauuugagaagcaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaccuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagcuaaagagggacugaaaagaggagaaacaaccaaacaugcagugucgagaggaaccgcuaaauugaggugguuuguggagaggaaccucgugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccuuuugugugacauuggugaguccucuccaaacccaacuauagaggaaggaagaacgcuacgcguccuaaagaugguggaaccauggcucagaggaaaucaauucugcauaaaaauucugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaauagauucacaauggcucacaggaaaccaacauaugaaagagacguggaccuaggcgccggaacaagacacguggcaguggaaccagagguagccaaccuagauaucauuggccagaggauugagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacaccuuuuggacaacagaggguguuuaaagagaaaguugacacacgcacaccaaaagcaaaacgaggcacagcacaaaucauggaggugacagccaggugguuaugggguuuucuuucuagaaacaagaagccaagaauuuguacaagagaggaguucacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaguuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggacacaaggauaacagaggaugaccuucagaaugaggccaaaauuacugacaucauggaacccgaacaugccuuacuggcuaaagcaaucuucaagcuaacauaccaaaauaaagugguaaggguacagagaccagcaaaaaaugggaccgugauggaugucauauccagacgugaccagagaggaaguggccaggucggaacuuauggcuuaaacacuuucacuaacauggaagcccagcugauaagacaaauggagucugagggaaucuuuuuacccagugaauuagagaccccaaauuuagcugagagaguucucgacuggcuggaaaaauauggcgucgaaaggcugaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagauaugcugucaguguggaauaggguuuggauagaggaaaacccauggauggaggauaaaacccauauauccaguugggaagauguuccauauuuggggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5287 - RNA, 9879 nt, Artificial Sequence
  derived and/or modified CDS sequence (wt) from DENV-1__HM469966__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccuagaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccuccgaaggcgcuuggaaacagauacaaagaguggagacuugggcccugagacacccaggauucacggugauagcccucuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagauguggugcuggaacauggaaguugugucacuaccauggcaaaagacaaaccaacauuggacauugaacucuugaagacggaagucacaaauccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaaugguugugggcucuucggaaaaggaagccuuaugacgugugcuaaguucaagugugugacaaaacuggaaggaaaaauaguucaauaugaaaacuugaaauauucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauagucacugacaaagaaaaaccagucaacauugaggcagaaccgccuuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucucuuucgaugacgugcauugcaguuggccugguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaaggaaaaaaaaugauuaggccacaacccauggaauacaaauacucguggaaaagcuggggaaaggcuaaaaucauaggggcagauguacagaacaccaccuucaucaucgacggcccaaacaccccagaaugcccugaugaucaaagagcguggaacauuugggaaguugaggauuauggauuuggaauuuucacgacaaacauauggcugaaauuacgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucauggucggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaacuauugacugacuuucaaucacaucagcugugggcuaccuugcuguccuugacauuuaucaaaacaacguuuuccuugcauuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcggaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagagaacguguuccacacaauguggcaugucaccaggggagcuguacucauguaucaagggaagagacuagaaccgagcugggccagugucaaaaaagaccugaucucauauggaggagguuggaggcuucaaggauccuggaacacgggagaagaagugcaggugauugcuguugaaccagggaagaacccaaaaaauguacaaacagcgccgggcaccuuuaagaccccugaaggcgaaguuggagccauugcccuagauuuuaaaccuggcacaucuggaucucccaucgugaacagagaaggaaaaauaguaggucuuuauggaaauggaguagugacaacaaguggaaccuacgucagugccauagcucaagcuaaagcaucacaggaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacucgagugggcaugggugaagcagcugcgaucuucaugacagccacucccccaggaucaguggaggccuuuccacagagcaacgcaguuauccaagaugaggaaagagacauuccugagagaucauggaacucaggcuaugacuggaucacugacuucccaggcaaaacaguuugguuuguuccaagcauuaaaucaggaaaugauauugccaacugcuuaagaaagaauggaaaacgggugauucaauugagcaggaaaaccuuugacacagaguaccaaaaaacaaaaaauaacgacugggacuacgucgucacaacagacaucucagaaaugggagcaaauuuccgggccgacagggugauagacccaagacggugucugaaaccgguaauacuaaaagaugguccagagcgugucguuuuagcaggaccgaugccagugacuguggccagugccgcucagaggagaggaagaauuggaaggaaccacaauaaggaaggugaucaguacauuuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaacgccuuggacaaccugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauagccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggauugcuggaaaccacaaagaaagacuuagggauuggccauguggcuguugaaaaucaccaccaugccgcaauacuggacguagacuuacauccagcuucagccuggacccucuaugcaguggccacaacaauuaucacucccaugaugaggcacacaaucgaaaacacaacggcaaacauuucccugacagccauugcaaaccaggcagcgauauugaugggacuugacaaaggauggccaauaucaaagauggacauaggaguuccacuucucgccuuagggugcuauucccagguaaauccacugacgcugacagcggcgguauugaugcuaguagcucauuacgcuauaauuggaccuggacugcaagcaaaagcuacuagagaggcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucuggaagggaucuccaggaaaauuuuggaacaccacgauagcaguuuccauggcaaacauuuucaggggaaguuaucuagcaggagcaggucuggccuucucauuaaugaaaucccuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaaggggagaaacaaccaaacaugcagugucgaggggaaccgcuaaauugaggugguuuguggagaggaaccuugugaaaccagaagggaaagucauagaccucgguuguggaagagguggcuggucauacuauugcgcugggcugaagaaagucacagaagugaagggauacacaaaaggaggaccuggacaugaagaaccaaucccaauggcgaccuauggauggaaccuaguaaagcuguacuccgggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacacaaaucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuaggaauaagaaaccaagaauuuguacaagagaggaguucacaagaaaaguuaggucaaacgcagccaucggagcaguguucguugacgaaaaucaauggaacucagcaaaagaagcaguagaagaugagcgguucugggaccuugugcauagagagagggagcuucacaaacagggaaaaugugccacguguguuuacaacaugauggggaagagagagaaaaagcuaggagaguuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaacaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaagaugggagggaaauaguggugccaugccgcaaccaagaugaacuuguggguagggcuagaguaucacaaggugcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauagaguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5288 - RNA, 9879 nt, Artificial Sequence
  derived and/or modified CDS sequence (wt) from DENV-1__JX669462__SS-prME
uccgugaccaugcuccucaugcugcugcccacagcccuggcguuucauuugaccacacgagggggagagccacacaugauaguuaguaagcaggaaagaggaaagucacucuuguuuaagaccucagcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggagacaaauacaaagaguggaaacuugggcuuugagacacccaggauucacggugauagccuuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaaaggaagucuauugacgugugccaaguucaagugugugacaaaacuagagggaaagauaguucaauaugaaaacuuaaaauauucagugauagucacuguucacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuugggaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaagggaaaaaaaugauuaggccacaaccuauggaacacaaauacucauggaaaagcuggggaaaagcuaaaaucauaggagcagacauacaaaauaccaccuucaucaucgauggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacucucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucucauaacagaaaacaaaaucuggggaaggaaaaguuggccccucaaugaaggaauuauggcuauuggaauagucagcauucuacuaagcucacuccuaaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagcuauagcucuagauuucaaacccggcacaucuggaucucccauugugaacagagagggaaaaauagugggucuguauggaaauggaguggugacaacaaguggaaccuaugucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccugggaauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugauacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaacacuuucaccaauauggagguccaacuaauaagacaaauggaaucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaauauacaaguagccauaaaccaagugagaaggcucaucgggaaugagaauuauuuagauuacaugacaucaaugaagagauucaagaaugagagugaucccgaaggagcacucugguaa

SEQ ID NO: 5289 - RNA, 9879 nt, Artificial Sequence
  derived and/or modified CDS sequence (wt) from DENV-1__JX669463__SS-prME
uccgugaccaugcuccucaugcugcugcccacagcccuggcguuucauuugaccacacgagggggagagccacacaugauaguuaguaagcaggaaagaggaaagucacucuuguuuaagaccucagcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggagacaaauacaaagaguggaaacuugggcuuugagacacccaggauucacggugauagcuuuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuauugacgugugccaaguucaagugugugacaaaacuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacucagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuugggaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaaccuauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacucucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccuaaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauauuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccugggaauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguugugggagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaacacuuucaccaauauggagguccaacuaauaagacaaauggagucugaaggaaucuuuuuacccagugaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaauauacaaguagccauaaaccaagugagaaggcucaucgggaaugagaauuauuuagauuacaugacaucaaugaagagauucaagaaugagagugaucccgaaggagcacucugguaa

SEQ ID NO: 5290 - RNA, 9879 nt, Artificial Sequence
  derived and/or modified CDS sequence (wt) from DENV-1__JX669464__SS-prME
uccgugaccaugcuccucaugcugcugcccacagcccuggccuuccauuugacuacacgagggggagagccacacaugauagucagcaagcaggaaagaggaaagucacucuuguuuaagaccucuguaggugucaacaugugcacucucauugcgauggauuugggagaguuaugugaggacacaaugaccuacaaaugcccccggaucacugaggcggaaccagaugauguugacugcuggugcaaugccacagacacaugggugaccuaugggacguguucucaaaccggcgaacaccgacgagacaaacguuccgucgcacuggccccacacgugggacuuggucuagaaacaagaacugaaacguggaugucaucugaaggcgccuggaaacaaauacaaaaaguggagacuugggcuuugcgacacccaggauucacggugauagcccuuuucuuggcacaugccauaggaacauccaucacccagaaagggaucauuuucauuuugcugaugcugguaacaccaucaauggccaugcgaugcgugggaauaggcaauagagacuucguugaaggacugucaggagcaacguggguggaugugguacuggagcauggaagcugcgucaccaccauggcaaaaaacaaaccaacauuggacauugaacucuugaaaacggaggucacgaacccugccguccugcgcaaacugugcauugaagcuaaaauaucaaacaccaccaccgauucaagauguccaacacaaggagaagccacacugguggaagaacaagacgcgaacuuugugugucgacgaacguucguggacagaggcugggguaauggcugcggacuauuuggaaaaggaagucuacugacgugugcuaaguucaagugugugacaaaacuagaaggaaagauaguucaauaugaaaacuuaaaauauucagugauagucacuguucacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagacuuaccacugccuuggacuucgggagcuucaacaucccaagagacuuggaacagacaagauuugcuggucacauucaagacagcucaugcaaagaaacaggaaguagucgugcugggaucacaggaaggagcaaugcacacugcgcugacuggggcgacagaaauccagacgucaggaacgacaacaauuuuugcgggacaccugaaauguagacuaaaaauggacaaacugacuuuaaaagggaugucauaugugaugugcacaggcucauuuaagcuagagaaggaaguggcugagacccagcauggaacuguuuuagugcagguuaaauacgaaggaacagaugcaccaugcaagaucccuuuuuugacccaagaugagaaaggagugacccagaaugggagauugauaacagcuaauccuauaguuacugauaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggccauccugggagacacugcaugggacuucggcucuauaggaggauuguucacguccgugggaaaauugauacaccagguuuuuggaacugcauaugggguucuguucagcgguguuucuuggaccaugaaaauaggaauagggauucugcugacaugguugggauuaaauucaaggagcacgucacuuucaaugacgugcauugcaguuggcauggucacacuguaccuaggagucaugguucaagcggacucgggaugugugaucaacuggaagggcagagaacucaaauguggaaguggcaucuuugucacuaaugaaguccacacuuggacagagcaauacaaauuccaggcugacuccccaaaaagacugucagcagccauuggaaaggcaugggaggaaggcguguguggaauucgaucagccacgcgucuugagaacaucauguggaagcaaauaucaaaugaauugaacuacauccuacuugaaaaugacaugaaauucacagugguuguaggagacgucaauggaauuuuggcccaagggaaaaaaaugauuagaccacaacccauggaacacaaauacucauggaaaaguuggggaaaagccaagaucauaggagcagacauacagaacaccaccuuuaucauugacggcccagauacuccagaaugccccgaugaccaaagagcauggaacauuugggaaguugaggacuacggguucggaauuuucacgacaaacauauggcugaaauugcgugacucccacacccaaaugugugaccaucggcuaaugucagcugccaucaaggacagcaaagcaguccaugcugauaugggguacuggauagaaagugaaaagaacgagaccuggaagcuagcgagagccuccuuuauagaagucaagacaugcaucuggccgaaaucccacacucuauggaguaauggaguuuuggaaagugaaaugguaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggauaucgaggcccaucucucagaacuacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaauggacaguuuuucauuaggaauacuaugcguaucaauacugauugaagaaguaaugagauccagauggaguagaaagaugcugaugacuggaacacuggcuguuuuccuccuucucauaaugggacaacugacauggaaugaucugaucagguuaugcaucaugguuggagccaaugcuucagacaggauggggauggggacaacguaccuagccuugauggccacuuucaaaaugagaccaauguucgcuguugggcuauuauuucgcagacuaacauccagagaaguucuucuucucacgguuggauuaagccugguggcauccguggagcuaccaaauucuuuagaggagcuaggggauggacuugcaaugggcaucaugauguuaaaauuauugacugacuuccagccacaccaguuauggaccacccuauugucucuaacauuuaucagaacaucucuuucauuggauuaugcauggaagacaauggccauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccaucaaugaaggaauuauggcuguuggaauagucagcauucuacuaaguucacuccucaaaaaugaugugccgcuagccggcccacuaauagcuggaggcaugcuaauagcauguuaugucauaucuggaagcucagcugauuuaucauuggaaaaagcggcugagguauccugggaagaagaagcagaacacuccggcaccucacacaacauauuaguggagguccaagaugauggaacuaugaaaauaaaagaugaagagagggaugauacacucaccauacuccucaaagcaacucugcuggcagucucaggaguguacccaaugucaauaccggcaacucuuuuugugugguauuuuuggcagaaaaagaaacagagaucaggaguguuaugggacacacccagcccuccggaaguggaaagggcaguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagauuccugaaggcgaaguuggagccauagcucuagauuuuaaaccuggcacauccggaucucccaucgugaacagagagggaaaaauaguaggucuuuauggaaauggaguggugacaacaaguggaaccuacgucagugccaucgcucaagcuaaagcaacacaagaagggccucuaccagagauugaggacgagguguuuaagaaaagaaacuuaacaauaauggaccugcauccaggaucagggaaaacaagaagauaucuuccagccauaguccgugaggccauaaaaaggaagcugcgcacgcuaaucuuggcucccacaaggguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaauuacaacaugauuaucauggaugaagcacacuuuaccgauccagccagcauagcagccagaggguacaucucaacccgaguggguaugggugaagcagcugcgaucuucaugacagccacucccccaggaucgguggaggccuuuccacagagcaaugcaguuauccaagaugaggaaagagacauuccugagagaucauggaacucaggcuacgacuggaucacugauuuuccagguaaaacaguuugguuuguuccaagcaucaaaucaggaaaugacauugcuaacuguuuaagaaagaacggaaaacgggugauucaacugagcaggaaaaccuuugacacugaguaccagaaaacaaaaaacaaugacugggacuauguugucacaacagacauuuccgaaaugggagcaaauuuccgggccgacaggguaauagauccaaggcggugcuugaaaccgguaauacuaaaggaagguccagagcgcguuauucuagccggaccgaugccagugacuguggccagugccgcccagaggagaggaagaauuggaaggaaccaaaacaaagaaggugaucaguacauuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccaguuuggcuauccuacaaaguugccucagaagguuuccaauacuccgacagaagauggugcuuugauggggaaaggaauaaccaggugcuggaggagaacauggacguggagaucuggacaaaggaaggagaaagaaagaaauugcgaccccgcugguuggaugcuagaacauacucugacccacuggcccugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauuccgaacaaggaggaaaagccuacagacaugcuauggaagaacuaccagacaccauagaaacauugaugcuccuagccuugauagcugugcugacugguggagugacgcuguucuuccuaucaggaaaaggucuagggaaaacauccauuggccuacucugugugauggccucaagcgcacuguuauggauggccaguguggagccccauuggauagcggccuccaucauauuagaguucuuucugauggugcugcucauuccagagccagacagacagcgcacuccacaggacaaccaguuagcauauguggugauagguuuguuauucaugauacugacaguggcagcuaaugagaugggauuguuggaaaccacaaagaaagaccuggggauuggccauguagccgucgaaaaccaccaccaugccacaaugcuggacguagaccuacguccagcuucagccuggacccucuaugcaguagccacaacaguuaucacccccaugaugagacacacaauugaaaauacaacggcaaauauuucucugacagccaucgcaaaccaggcugcuauauugauggggcuugauaagggauggccaauaucgaagauggauauaggaguuccacuucucgccuuagggugcuauucccaggugaacccauugacacuaacagcggcgguguugauguuaguggcucauuaugccauaauuggaccaggacugcaagcaaaggccacuagagaagcucaaaaaaggacagcggccggaauaaugaaaaauccaaccguagacgggauugucacaauagacuuggauccugugguuuaugaugcaaaauuugaaaaacagcuaggccaaauaauguuacugauacuuuguacaucacagauucucuugaugcggaccacaugggccuugugugaauccaucacacuggcuacuggacccuugaccacucuuugggagggaucuccaggaaaauucuggaacaccacgauagcaguguccauggcaaacaucuucaggggaaguuaucuagcaggagcaggucuggccuucucguugaugaaaucuuuaggaggagguaggagagguacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucauagaccucgguugugggagaggugguuggucauauuacugcgcugggcugaagaaagucacugaagugaagggauacacaaaaggaggaccuggacaugaggaacccaucccaauggcgaccuauggauggaacuugguaaagcuacacucugggaaagauguauucuucacaccaccugagaaaugugacacccuuuugugugacauuggugaguccucuccaaauccaacuauagaagaaggaagaacauuacguguucuaaagaugguggaaccauggcuuagaggaaaccaauucugcauaaaaauccuaaauccuuacaugccaagugugguagaaacucuggagcaaaugcaaagaaaacauggagggaugcuagugcgaaacccacucucaagaaacuccacccaugaaauguacuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaacauaaaaaaugaacacaagucaacauggcauuaugaugaagacaauccauacaaaacaugggccuaucauggaucauaugaggucaaaccaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaaagaggcacagcacaaaucauggaggugacagccaagugguuaugggguuuccuauccagaaacaaaaaacccagaaucugcacaagagaggaguucacaagaaaaguuaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggccacgucaauuuuuaaacugaccuaccaaaauaagguggugagggugcaaagaccagcaaaaagugggaccgugauggaugucauauccagacgugaccagagaggaaguggacaggucggaacuuauggcuuaaauacuuucaccaauauggagguccaauuaauaagacaaauggagucugaaggaauuuuuuuacccagcgaauuggaaacccccaaucuggccaagaaaguucuugacuggcuggaaaaacauggcgcugaaaggcugaaaagaauggcaauuagcggagaugauuguguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaucagcugaucaugaaagauggaagagaaauaguggugccaugccgcaaccaagaugaacuugugggcagggcuagagugucacaaggcgcuggauggagccugagagaaacugcuugccuaggcaagucauaugcacaaauguggcagcugauguacuuucacaggagagaccugagacuagcggcuaaugcuaucuguucagccgucccaguugauugggucccaaccagccgcaccaccuggucgauccaugcccaccaccaauggaugacaacagaagacauguuaucaguguggaauaggguuuggauagaggaaaacccauggauggaagacaaaacucauguauccaguugggaagaaguuccauaccuagggaaaagggaagaccaaugguguggauccuugauagguuugacagcaagggccaccugggccacuaacauacaaguagccauaaaccaagugagaaggcucaucgggaaugagaauuaucuagauuauaugacaucaaugaagagauucaagaaugagagugaucccgaaggggcacucugguaa

SEQ ID NO: 5291 - RNA, 9879 nt, Artificial Sequence
  derived and/or modified CDS sequence (wt) from DENV-1__JX669465__SS-prME
uccgugaccaugcuccucaugcugcugcccacagcccuggccuuccauuugacuacacgagggggagagccacacaugauagucagcaagcaggaaagaggaaagucacucuuguuuaagaccucuguaggugucaacaugugcacucucauugcgauggauuugggagaguuaugugaggacacaaugaccuacaaaugcccccggaucacugaggcggaaccagaugauguugacugcuggugcaaugccacagacacaugggugaccuaugggacguguucucaaaccggcgaacaccgacgagacaaacguuccgucgcacuggccccacacgugggacuuggucuagaaacaagaacugaaacguggaugucaucugaaggcgccuggaaacaaauacaaaaaguggagacuugggcuuugcgacacccaggauucacggugauagcccuuuucuuggcacaugccauaggaacauccaucacccagaaagggaucauuuucauuuugcugaugcugguaacaccaucaauggccaugcgaugcgugggaauaggcaauagagacuucguugaaggacugucaggagcaacguggguggacgugguacuggagcauggaagcugcgucaccaccauggcaaaaaacaaaccaacauuggacauugaacucuugaaaacggaggucacgaacccugccguccugcgcaaacugugcauugaagcuaaaauaucaaacaccaccaccgauucaagauguccaacacaaggagaagccacacugguggaagaacaagacgcgaacuuugugugucgacggacguucguggacagaggcugggguaauggcugcggacuauuuggaaaaggaagucuacugacgugugcuaaguucaagugugugacaaaacuagaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagacuuaccacugccuuggacuucgggagcuucaacaucccaagagacuuggaacagacaagauuugcuggucacauucaagacagcucaugcaaagaaacaggaaguagucgugcugggaucacaggaaggagcaaugcacacugcgcugacuggggcgacagaaauccagacgucaggaacgacaacaauuuuugcgggacaccugaaauguagacuaaaaauggacaaacugacuuuaaaagggaugucauaugugaugugcacaggcucauuuaagcuagagaaggaaguggcugagacccagcauggaacuguuuuagugcagguuaaauacgaaggaacagaugcaccaugcaagaucccuuuuuugacccaagaugagaaaggagugacccagaaugggagauugauaacagccaauccuauaguuacugauaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggccauccugggagacaccgcaugggacuucggcucuauaggaggauuguucacgucugugggaaaauugauacaccagguuuuuggaacugcauaugggguucuguucagcgguguuucuuggaccaugaaaauaggaauagggauucugcugacaugguugggauuaaauucaaggagcacgucacuuucaaugacgugcauugcaguuggcauggucacgcuguaccuaggagucaugguucaagcggacucgggaugugugaucaacuggaagggcagagaacucaaauguggaaguggcaucuuugucacuaaugaaguccacacuuggacagagcaauauaaauuccaggcugacuccccaaaaagacugucagcagccauugggaaggcaugggaggaaggcguguguggaauucgaucagccacgcgucuugagaacaucauguggaagcaaauaucaaaugaauugaacuacauccuacuugaaaaugacaugaaauucacagugguuguaggagacguuaauggaauuuuggcccaaggaaaaaaaaugauuagaccacaacccauggaacacaaauacucauggaaaaguuggggaaaagcuaagaucauaggagcagacacacagaacaccaccuuuaucauugacggcccagauacuccagaaugucccgaugaccaaagagcauggaacauuugggaaguugaggacuacggguucggaauuuucacgacaaacauauggcugaaauugcgugacucccacacccaaaugugugaccaucggcuaaugucagcugccaucaaggacagcaaagcaguccaugcugauauggguuacuggauagaaagugaaaagaacgagaccuggaagcuagcgagagccuccuuuauagaagucaagacaugcaucuggccgaaaucccacacucuauggaguaauggaguuuuggaaagugaaaugguaaucccaaagacauauggaggaccaauaucucagcacaacuacagaccaggguauuucacacaaacagcagggccauggcaccuaggcaaguuggaauuggauuuugacuugugugaagguaccacaguuguuguagaugaacauuguggauaucgaggcccaucucucagaacuacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaauggacaguuuuucauuaggaauacuaugcguaucaauacugauugaagaaguaaugagauccagauggaguagaaagaugcugaugacuggaacacuggcuguuuuccuccuucucauaaugggacaacugacauggaaugaucugaucagguuaugcaucaugguuggagccaaugcuucagacaggauggggauggggacaacguaccuagccuugauggccacuuucaaaaugagaccaauguucgcuguugggcuauuauuucgcagacuaacauccagagaaguucuucuucucacgguuggauuaagccugguugcauccguggagcuaccaaauucuuuagaggagcuaggggauggacuugcaaugggcaucaugauguuaaaauuauugacugacuuccagccacaccaguuauggaccacccuauugucucuaacauuuaucagaacaucucuuucauuggauuaugcauggaagacaauggcuauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccaucaaugaaggaauuauggcuguuggaauagucagcauucuacuaaguucacuccucaaaaaugaugugccgcuagccggcccacuaauagcuggaggcaugcuaauagcauguuaugucauaucuggaagcucagcugauuuaucauuggaaaaagcggcugagguauccugggaagaagaagcagaacacuccggcaccucacacaacauauuaguggagguccaagaugauggaacuaugaaaauaaaagaugaagagagggaugauacacucaccauacuccucaaagcaacucugcuggcagucucaggaguguacccaaugucaauaccggcaacucuuuuugugugguauuuuuggcagaaaaagaaacagagaucaggcguguuaugggacacacccagcccuccggaaguggaaagggcaguucuugaugauggcauuuauagaaucuugcaaagaggacuguugggcaggucccaaguaggagugggaguuuuccaagacggcguguuccauacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccgggcaccuucaagacuccugaaggcgaaguuggagccauagcucuagauuuuaaacccggcacauccggaucucccaucgugaacagagagggaaaaauaguaggucuuuauggaaauggaguggugacaacaaguggaaccuacguuagugccaucgcucaagcuaaagcaacacaagaagggccucuaccagagauugaggacgagguguuuaagaaaagaaacuuaacaauaauggaccugcacccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaauuacaacaugauuaucauggaugaagcacauuuuaccgauccagccagcauagcagccagaggguacaucucaacccgaguggguaugggugaagcagcugcgaucuucaugacagccacucccccaggaucgguggaggccuuuccacagagcaaugcaguuauccaagaugaggaaagagacauuccugagagaucauggaacucaggcuaugacuggaucacugauuuuccagguaaaacaguuugguuuguuccaagcaucaaaucaggaaaugacauugcuaacuguuuaagaaagaacggaaaacgggugauucaacugagcaggaaaaccuuugacacugaguaccagaaaacaaaaaacaaugacugggacuacguugucacaacagacauuuccgaaaugggagcaaauuuccgggcugacaggguaauagauccaaggcggugcuugaaaccgguaauacuaaaggaaggcccagagcgcguuauucuagccggaccgaugccagugacuguggccagugccgcccagaggagaggaagaauuggaaggaaccaaaacaaagaaggugaucaguacauuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccaguuuggcuauccuacaaaguugccucagaagguuuccaauacuccgacagaagauggugcuuugauggggaaaggaauaaccagguguuggaggagaacauggacguggagaucuggacaaaggaaggagaaagaaagaaauugcgaccccgcugguuggaugcuagaacauacucugacccacuggcccugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauuccgaacaaggaggaaaagccuacagacaugccauggaagaacuaccagacaccauagaaacauugaugcuccuagcuuugauagcugugcugacugguggagugacgcuguucuuccuaucaggaaaaggucuagggaaaacauccauuggccuacucugugugauggccucaagcgcacuguuauggauggccaguguggagccccauuggauagcggccuccaucauauuagaguucuuucugauggugcugcucauuccagagccagacagacagcgcacuccacaggacaaccaguuagcauauguggugauagguuuguuauucaugauacugacaguggcagcuaaugagaugggauuguuggaaaccacaaagaaagaccuggggauuggccauguagccgucgaaaaccaccaccaugccacaaugcuggacguagaccuacguccagcuucagccuggacccucuaugcaguagccacaacaguuaucacccccaugaugagacacacaauugaaaauacaacggcaaauauuucccugacagccaucgcaaaccaggcugcuauauugauggggcuugauaagggauggccaauaucgaagauggauauaggaguuccacuucucgccuuagggugcuauucccaggugaacccauugacacuaacagcggcgguguugauguuaguggcucauuaugccauaauuggaccaggacugcaagcaaaggccacuagagaagcucaaaaaaggacagcggccggaauaaugaaaaauccaaccguagacgggauugucacaauagacuuggauccugugguuuaugaugcaaaauuugaaaaacagcuaggccaaauaauguuacugauacuuuguacaucacagauucucuugaugcggaccacaugggccuugugugaauccaucacacuggcuacuggacccuugaccacucuuugggagggaucuccaggaaaauucuggaacaccacgauagcaguguccauggcaaacaucuucaggggaaguuaucuagcaggagcaggucuggccuucucguugaugaaaucuuuaggaggagguaggagagguacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucauagaccucgguugugggagaggugguuggucauauuacugcgcugggcugaagaaagucacugaagugaagggauacacaaaaggaggaccuggacaugaggaacccaucccaauggcgaccuauggauggaacuugguaaagcuacacucugggaaagauguauucuucacaccaccugagaaaugugacacccuuuugugugacauuggcgaguccucuccaaauccaacuauagaagaaggaagaacauuacguguucuaaagaugguggaaccauggcuuagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaacauaaaaaaugaacacaagucaacauggcauuaugaugaagacaauccauacaaaacaugggccuaucauggaucauaugaggucaaaccaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaaagaggcacagcacaaaucauggaggugacagccaagugguuaugggguuuccuauccagaaacaaaaaacccagaaucugcacaagagaggaguucacaagaaaaguuaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauucccgggggaaauauguaugcagaugacacagccggaugggacacaagaauaacagaggaugaucuucagaaugaggcuaaaaucacugacaucauggagccugaacaugcucuauuggccacgucaauuuuuaaacugaccuaccaaaauaagguggugagggugcaaagaccagcaaaaagugggaccgugauggaugucauauccagacgugaccagagaggaaguggacaggucggaacuuauggcuuaaauacuuucaccaauauggagguccaauuaauaagacaaauggagucugaaggaauuuucucacccagcgaauuggaaacccccaaucuagcuaagaaaguucuugacuggcuggaaaaacauggcgcugaaaggcugaaaagaauggcaauuagcggagaugauugcguggugaaaccaauugaugacagguucgcaacagccuuaacagcuuugaaugauaugggaaaaauaagaaaagacauaccgcagugggaaccuucaaaaggauggaaugacuggcagcaagucccuuucuguucacaccacuuccaucagcugaucaugaaggauggaagagaaauaguggugccaugccgcaaucaagaugaacuugugggcagggcuagaguaucacaaggcgcuggauggagccugagagaaacugcuugccuaggcaagucauaugcacaaauguggcagcugauguacuuucacaggagagaccugagacuagcggcuaaugcuaucuguucagccgucccaguugauugggucccaaccagccgcaccaccuggucgauccaugcccaccaccaauggaugacaacagaagacauguuaucaguguggaauaggguuuggauagaggaaaacccauggauggaagacaaaacucauguauccaguugggaagaaguuccauaccuagggaaaagggaagaucaaugguguggauccuugauagguuugacagcaagggccaccugggccacuaauauacaaguagccauaaaccaagugagaaggcucaucgggaaugagaauuaucuagauuauaugacaucaaugaagagauucaagaaugagagugaucccgaaggggcacucugguaa

SEQ ID NO: 5292 - RNA, 9879 nt, Artificial Sequence
  derived and/or modified CDS sequence (wt) from DENV-1__JX669466__SS-prME
uccgugaccaugcuccucaugcugcugcccacagcccuggcguuucauuugaccacacgagggggagagccacacaugauaguuaguaagcaggaaagaggaaagucacucuuguuuaagaccucagcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggagacaaauacaaagaguggaaacuugggcuuugagacacccaggauucacggugauagccuuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuauugacgugugccaaguucaagugugugacaaaacuagagggaaagauaguucaauaugaaaacuuaaaauauucagugauaguuacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuauccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuugggaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauuugggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaaccuauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguacuacaguuguuguagaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccuaaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagccaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucuccuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccugggaauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaacacuuucaccaauauggagguccaacuaauaagacaaauggaaucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaauauacaaguagccauaaaccaagugagaaggcucaucgggaaugagaauuauuuagauuacaugacaucaaugaagagauucaagaaugagagugaucccgaaggagcacucugguaa

SEQ ID NO: 5293 - RNA, 9879 nt, Artificial Sequence
  derived and/or modified CDS sequence (wt) from DENV-1__JX669467__SS-prME
uccgugaccaugcuccucaugcugcugcccacagcccuggcguuccauuugaccacacgagggggagagccacacaugauaguuaguaagcaggaaagaggaaagucacucuuguucaagaccucugcaggugucaauaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacucggucuagaaacaagaaccgaaacauggaugucuucugaaggcgccuggaaacaaauacaaaaaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucgucgaaggacugucaggagcaacguggguagacgugguauuggagcauggaagcugcgucaccaccauggcaaaaaauaaaccaacauuggacauugaacucuugaagacggaggucacgaacccugccgucuugcgcaaacugugcauugaagccaaaauaucaaacaccaccaccgauucaagauguccaacacaaggagaggcuacacugguggaagaacaagacgcgaacuuugugugucgccgaacguuuguggacagaggcugggguaauggcugcggauuauucggaaaaggaagccuguugacgugugccaaguucaagugugugacaaaacuagaaggaaagauaguucaauaugaaaacuuaaaauauucagugauagucaccguccacacuggggaucagcaccaggugggaaacgagacuacagaacauggaacaauugcaaccauaacaccucaagcuccuacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaagaaggagcaaugcacaccgcguugacuggggcgacagaaauccagacgucaggaacgacaacaaucuuugcagggcaccugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagaugcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaauugguacaccagguuuuuggaaccgcauaugguguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauuggaagggcaugggaggagggcguguguggaauucgaucagccacgcgucuugagaacaucauguggaagcaaauaucaaaugaauugaaccacauucuacuagaaaaugacauaaaauucacagugguuguaggaaaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauacuccagaaugccccgaugaacaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccucguucauagaagucaagacaugcaucuggccgaaaucccacacucuauggaguaauggaguuuuggaaagugaaaugauaaucccaaagauguauggaggaccaauaucucagcacaacuacagaccaggguauuucacacaaacagcagggccauggcaucuaggcaaguuggaauuggauuuugacuugugugaaggaaccacaguuguuguggaugaacauuguggaagucgagguccaucucucagaacuacaacagucacaggaaagauaauccaugaaugguguugcagauccugcacguuaccccccuuacguuucagaggagaagacggauguugguaugguauggaaaucagaccaguuaaggagaaggaggagaaccuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaagauggggaugggaacaacguaccuagccuugauggcuacuuucaaaaugagaccaauguucgcuguugggcuauuauuucgcagacuaacauccagagaaguucuucuucucacgauuggauuaagccugguggcauccguggagcuaccaaauucuuuggaggagcuaggggauggacuugcaauggguaucaugauguuaaaauuauugacugaauuucagccacaccaguuauggaccaccuuacuuucucugacauuuaucaaaacaacucuuucauuggauuacgcauggaagacaacggcuacgguacugucaaucguaucucucuuuccuuuaugccugucuacgaccucucaaaaaacaacauggcuuccggugcuguuaggaucuuuuggaugcaaaccauuaaccauguuucucauaacagaaaacgaaaucuggggaagaaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgaucuaucauuggagaaagcggcugagguauccugggaagaagaagcagaacacuccgguaccucacacaacauauuaguagagguucaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcgguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauagcccaagcuaaagcaucacaggaagggccucuaccagagauugaggacgagguguuuaagaaaagaaacuuaacaauaauggaccuccauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugagcacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaauucaggcuacgacuggaucacugauuuuccagguaaaacagucugguuuguuccaagcauuaaaucaggaaaugacauugccaacugcuuaagaaagaacggaaaacggguaauccaauugagcagaaaaaccuuugacacugaguaccagaaaacaaaaaacaaugacugggacuauguugucacaacagacauuucugaaaugggggcaaauuuccgggcugacaggguaauagacccaaggcggugcuugaaaccgguaauacuaaaagaugguccagagcguguuauucuagccggaccgaugccagugacuguggccagugcugcccaaaggagaggaagaauuggaaggaaccagaacaaggaaggugaucaguaugucuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugauggagaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagacuuacauccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggaccuaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaaucuaucacacuggcuacuggaccccugaccacucuuugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacauuaggagagaaauggaaaagacaguuaaaccaacugagcaagucagaauucaacaccuacaaaaggagugggauuauggagguggacagaucugaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuagugaagcugcacucuggaaaagauguauuuuuuaugccaccugagaaaugugacacccuucugugugauauuggugaguccucuccgaauccaacuauagaagaagguagaacgcuacguguucuaaagaugguggaaccauggcucagaggcaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucaugugggacaggaaacauugugucggcagugaacaugacauccagaauguugcugaaucgauucacaauggcucauaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugagguuaagccaucaggaucagccucaucuauggugaauggaguggugagauugcucacaaaaccaugggauguuauccccauggucacacaaauagcuaugacugauaccacacccuuuggacaacagagaguguuuaaagagaagguugacacgcgcacaccaagagcaaaacgaggcacagcacaaauuauggaagugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaggcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugaccuaccaaaacaagguggugagggugcaaagaccagcaaaaaauggaaccgugauggauguuauauccagacgugaccagagaggaaguggacaggucggaacuuauggcuuaaauacuuucacuaauauggagguccaacuaauaagacaaauggagucugaaggaaucuuuuuucccagcgaauuggaaagccccaaucuagcugaaagaguucuugacugguuggaaaaacauggcgccgaaaggcugaaaagaauggcaaucagcggagaugauuguguagugaaaccaauugaugacagauucgcaacagccuuaauagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaaugcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5294 - RNA, 9879 nt, Artificial Sequence
  derived and/or modified CDS sequence (wt) from DENV-1__HM469967__SS-prME
ucugugaccaugcuccuuaugcugaugccuacggccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccauuacccagaaagggauuauuuuuauuuuguuaaugcugguaacaccauccauggccaugcgaugcgugggaauaggcagcagggacuucguggaaggacugucaggagcaacuuggguggauguggugcuggaacauggaagcugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacgcaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcauacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaacccuauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauagggggaguguucacgucuguuggaaaauuaguacaccagauuuuuggaacugcauauggaguuuuguucagcgguguuuccuggaccaugaaaauaggaauagggguucugcuaacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggagggugugugcggaauucgaucagcaacucgucucgagaacaucauguggaagcaaauaucaaaugaacugaaccacaucuuacuugaaaaugacaugaaauucacagugguuguaggagauguugcugggaucuuggcucaagggaaaaaaaugauuaggccacaacccauggaauacaaauacucguggaaaagcuggggaaaggcuaaaaucauaggggcagauguucagaacaccaccuucaucaucgacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacccuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaauuuaguuaaaucaauggucucugcagggucaggggaaguggauagcuuuucacuaggacugcuaugcauaucgauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaauggguaucaugauuuuaaaacuauugacugacuuucaaucacaucaguugugggcuaccuugcuguccuugacauuuaucaaaacgacguuuucauugcacuaugcauggaagacaauggcuaugguacugucaauuguaucucucuuccccuugugccuguccacgaccucccaaaaaacaacauggcuuccggugcuguugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuaugucauaucuggaagcucagccgaccuaucacuagagaaagcagcugaagucuccugggaagaagaagcagaacacucuggugccucacauaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccaaaaguggaaagagcaguucuugaugaugguaucuauagaauuaugcagagaggacuguugggcaggucccaaguaggggugggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguagaaccagggaaaaaccccaaaaauguacaaacagcgccgggcaccuuuaagaccccugaaggugaaauuggagccauugcccuagauuuuaaacccggcacaucuggaucucccaucgugaacagagaaggaaaaauaguaggccuuuauggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacgagaagauaucuuccagccauaguccgugaggccauaaaaagaaagcugcgcacacuaauucuggcucccacaaggguugucgcuuccgaaauggcagaggcgcucaagggaaugccaauaagguaccaaacaacagcagugaagagugaacacacagggaaagagauaguugaccucaugugucacgccacuuucaccaugcgccuucugucucccgugagaguucccaauuacaacaugauuaucauggaugaagcacauuuuaccgauccaucuagcauagcggccagaggguacaucucaacccgagugggcaugggugaagcagccgcgaucuucaugacagccacucccccaggaucaguggaggccuuuccacagagcaacgcaguuauccaagacgaggaaagagacaucccugagagaucauggaacucaggcuaugaguggaucacugacuuuccaggcaaaacaguuugguuuguuccaagcauuaaagcaggaaaugacauugccaacugcuuaagaaagaaugggaaacgggugauucaauugagcaggaaaaccuuugauacagaguaccaaaaaacaaaaaauagcgacugggacuacgucgucacaacagacaucuccgaaaugggagcaaauuuccgggccgacaggguaauagacccaagacggugucugaaaccgguaauacuaaaagaugguccagagcguguuauuuuagcaggaccgaugccagugacuguggccagugccgcccagaggagaggaagaguuggaaggaaccacaacaaggaaggugaucaguacaucuacaugggacagccuuuaaacaacgaugaagaucacgcucauuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggaacucaugagaagaggagaucuaccugucuggcuauccuacaaaguagccucagaaggcuuccaguacucugacagaagaugguguuuugacggggaaaggaacaaccagguguuggaggagaacauggacguggagaucuggacaaaagaaggagaaagaaagaaacuacgaccccgcuggcuggaugccagaacauacucagacccauuggcccugcgcgaguuuaaagaguuugcagcaggaagaagaagcgucucaggugaucuaauauuggaaauagggaaacuuccacaacacuugacgcaaagggcccagaaugccuuggacaaccugguuauguugcacaauuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggcuaguguggagccccauuggauagcggccuccaucauacuggaguucuuccugauggugcugcuuauuccagagccagacagacaacgcacuccgcaggacaaccagcuggcauauguggugauagguuuauuauucaugauacugacaguagcagccaaugagaugggacugcuggaaaccacaaagaaagauuuagggauuggccauguggcuguugaaaaucaccaccacgccgcaaugcuggacguagacuuacauccagcuucagccuggacccucuaugcaguggccacaacaauuaucacucccaugaugaggcacacaauugaaaacacaacggcaaacauuucucugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaggcucaaaaaaggacagcggccggaauaaugaaaaauccaaccguugauggaauuguugcgauagauuuggacccugugguuuaugaugcaaaauuugagaaacaacuaggccaaauaauguuguugauacuauguacaucacagauccucuugaugcggacuacaugggccuugugcgaaucuaucacacuggccacuggaccucugaccacgcuuuggaagggaucuccaggaaaauuuuggaacaccacgauagcgguuuccauggcaaacauuuucagaggaaguuaucuagcgggagcaggucuggccuucucauuaaugaaaucucuaggaggagguaggagaggcacgggagcccaaggggaaacacugggagagaaauggaaaagacagcugaaccaacugagcaagucagaauucaauaccuauaaaaggagugggauuauggaaguggacagauccgaagccaaagagggacugaaaagaggagaaacaaccaaacacgcagugucgagaggaaccgcuaaacugaagugguuuguggagaggaaccuugugaaaccagaagggaaagucauagaccucgguuguggaagagguggcuggucauacuauugcgcugggcugaagaaagucacagaagugaagggauauacaaagggaggaccuggacaugaggaaccaaucccaauggcgaccuauggauggaaccuaguaaagcugcacuccgggaaagacguauucuuuauaccaccugagaaaugugacacccuuuugugugauauuggugaguccucuccaaacccaacuauagaggaaggaagaacgcuacgcguccuaaagaugguggaaccauggcucagaaaaaaucaauuuugcauaaaaauucugaauccuuacaugccaagugugguggaaacucuggagcaaaugcaaagaaaacaugggggaaugcuaguacgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaacggcguggugaaacugcucaccaaaccaugggaugucauccccauggucacacaaauagccaugacagacaccacgcccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauuggagcaguguucguugaugaaaaucaauggaauucagcaaaagaagcaguggaagaugagcgguucugggaccuugugcacagagagagggagcuucacaaacagggaaaaugugccacguguguuuauaacaugauggggaagagagagaaaaagcuaggagaguucggaaaggcaaaaggaagucgugcaauaugguacaugugguugggagcucgcuuucuagaguucgaagcucucgguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuauuggccaagucaaucuucaagcuaaccuaccaaaauaaggugguaaggguacagagaccagcaaaaaauggaaccgugauggaugucauauccagacgugaccagagaggaaguggccaggucggaacuuauggccuaaacacuuucaccaacauggaagcucagcugauaagacaaauggagucugagggaaucuucucacccagcgaauuagaaaccccaaauuuagccgagagaguucucgacuggcuggaaaaauauggcgucgaaaggcugaaaagaauggcaaucagcggagaugacugcguagugaaaccaauugaugauagguuugcaacagccuuaacagcucuaaaugauaugggaaaaguaagaaaagauauaccacaaugggaaccuucaaaaggauggaaugauuggcaaaaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucaauccaugcccaucaccaauggaugacaacagaagacaugcugucaguguggaauaggguuuggauagaggaaaacccauggauggaggacaaaacccauauauccaguugggaagauguuccauacuugggaaaaagggaagaucaaugguguggaucccugauaggcuuaacagcaagggccaccugggccaccaacauacaaguggccauaaaccaagugagaagauuaauugggaaugagaauuaucuagauuacaugacaucaaugaagagauucaagaacgagagugaucccgaaggggcacucugguga

SEQ ID NO: 5295 - RNA, 9879 nt, Artificial Sequence
  derived and/or modified CDS sequence (wt) from DENV-1__JX669468__SS-prME
uccgugaccaugcuccucaugcugcugcccacagcccuggcguuccauuugaccacacgagggggagagccacacaugauaguuaguaagcaggaaagaggaaagucacucuuguucaagaccucugcaggugucaauaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacucggucuagaaacaagaaccgaaacauggaugucuucugaaggcgccuggaaacaaauacaaaaaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucgucgaaggacugucaggagcaacguggguagacgugguauuggagcauggaagcugcgucaccaccauggcaaaaaauaaaccaacauuggacauugaacucuugaagacggaggucacgaacccugccgucuugcgcaaacugugcauugaagccaaaauaucaaacaccaccaccgauucaagauguccaacacaaggagaggcuacacugguggaagaacaagacgcgaacuuugugugucgccgaacguuuguggacagaggcugggguaauggcugcggauuauucggaaaaggaagccuguugacgugugccaaguucaagugugugacaaaacuagaaggaaagauaguucaauaugaaaacuuaaaauauucagugauagucaccguccacacuggggaucagcaccaggugggaaacgagacuacagaacauggaacaauugcaaccauaacaccucaagcuccuacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaagaaggagcaaugcacaccgcguugacuggggcgacagaaauccagacgucaggaacgacaacaaucuuugcagggcaccugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagaugcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaauugguacaccagguuuuuggaaccgcauaugguguucuguucagcgguguuucuuggaccaugaaaauaggaauagggauucugcugacauggcugggauuaaauucaaggagcacgucacuuucgaugacgugcauugcaguuggcaugguuacacuguaccuaggagucaugguucaagcggacucgggauguguaaucaacuggaagggcagagaacucaaauguggaaauggcauuuuugucacuaaugaaguccacacuuggacagagcaauacaaauuccaggcugacuccccaaaaagacugucagcagccauuggaagggcaugggaggagggcguguguggaauucgaucagccacgcgucuugagaacaucauguggaagcaaauaucaaaugaauugaaccacauucuacuagaaaaugacauaaaauucacagugguuguaggaaaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauacuccagaaugccccgaugaacaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccucguucauagaagucaagacaugcaucuggccgaaaucccacacucuauggaguaauggaguuuuggaaagugaaaugauaaucccaaagauguauggaggaccaauaucucagcacaacuacagaccaggguauuucacacaaacagcagggccauggcaucuaggcaaguuggaauuggauuuugacuugugugaaggaaccacaguuguuguggaugaacauuguggaagucgagguccaucucucagaacuacaacagucacaggaaagauaauccaugaaugguguugcagauccugcacguuaccccccuuacguuucagaggagaagacggauguugguaugguauggaaaucagaccaguuaaggagaaggaggagaaccuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagccaaugcuucagacaagauggggaugggaacaacguaccuagccuugauggcuacuuucaaaaugagaccaauguucgcuguugggcuauuauuucgcagacuaacauccagagaaguucuucuucucacgauuggauuaagccugguggcauccguggagcuaccaaauucuuuggaggagcuaggggauggacuugcaauggguaucaugauguuaaaauuauugacugaauuucagccacaccaguuauggaccaccuuacuuucucugacauuuaucaaaacaacucuuucauuggauuacgcauggaagacaacggcuacgguacugucaaucguaucucucuuuccuuuaugccugucuacgaccucucaaaaaacaacauggcuuccggugcuguuaggaucuuuuggaugcaaaccauuaaccauguuucucauaacagaaaacgaaaucuggggaagaaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgaucuaucauuggagaaagcggcugagguauccugggaagaagaagcagaacacuccgguaccucacacaacauauuaguagagguucaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcgguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauagcccaagcuaaagcaucacaggaagggccucuaccagagauugaggacgagguguuuaagaaaagaaacuuaacaauaauggaccuccauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugagcacacaggaagggagauaguugaccucaugugccacgccacuuuuaccaugcgucucuuauccccagugagaguucccaauuacaacaugaucauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaauucaggcuacgacuggaucacugauuuuccagguaaaacagucugguuuguuccaagcauuaaaucaggaaaugacauugccaacugcuuaagaaagaacggaaaacggguaauccaauugagcagaaaaaccuuugacacugaguaccagaaaacaaaaaacaaugacugggacuauguugucacaacagacauuucugaaaugggggcaaauuuccgggcugacaggguaauagacccaaggcggugcuugaaaccgguaauacuaaaagaugguccagagcguguuauucuagccggaccgaugccagugacuguggccagugcugcccaaaggagaggaagaauuggaaggaaccagaacaaggaaggugaucaguaugucuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugauggagaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagacuuacauccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggaccuaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaaucuaucacacuggcuacuggaccccugaccacucuuugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacauuaggagagaaauggaaaagacaguuaaaccaacugagcaagucagaauucaacaccuacaaaaggagugggauuauggagguggacagaucugaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuagugaagcugcacucuggaaaagauguauuuuuuaugccaccugagaaaugugacacccuucugugugauauuggugaguccucuccgaauccaacuauagaagaagguagaacgcuacguguucuaaagaugguggaaccauggcucagaggcaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucauaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacagcacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaggcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucacuaauauggagguccaacuaauaagacaaauggagucugaaggaaucuuuuuucccagcgaauuggaaagccccaaucuagcugaaagaguucuugacugguuggaaaaacauggcgccgaaaggcugaaaagaauggcaaucagcggagaugauugcguagugaaaccaauugaugacagauucgcaacagccuuaauagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaaugcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5296 - RNA, 9879 nt, Artificial Sequence
  derived and/or modified CDS sequence (wt) from DENV-1__JX669469__SS-prME
uccgugaccaugcuccucaugcugcugcccacagcccuggcguuccauuugaccacacgagggggagagccacacaugauaguuaguaagcaggaaagaggaaagucacucuuguucaagaccucugcagguguuaauaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacucggucuagaaacaagaaccgaaacauggauguccucugaaggcgccuggaaacaaauacaaaaaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguagacgugguauuggagcauggaagcugcgucaccaccauggcaaaaaauaaaccaacauuggacauugaacucuugaagacggaggucacgaacccugccgucuugcgcaaacugugcauuaaagccaaaauaucaaacaccaccaccgauucaagauguccaacacaaggagaggcuacacugguggaagaacaagacgcgaacuuugugugucgccgaacguuuguggacagaggcugggguaauggcugcggauuauucggaaaaggaagucuauugacgugugccaaguucaagugugugacaaaacuagaaggaaagauaguucaauaugaaaacuuaaaauauucagugauagucaccguccacacuggggaucagcaccaggugggaaacgagacuacagaacauggaacaauugcaaccauaacaccucaagcuccuacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaagaaggagcaaugcacaccgcguugacuggggcgacagaaauccagacgucaggaacgacaacaaucuuugcagggcacuugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagaugcgccaugcaagauccccuuuucgacccaagaugagaaaggggugacccagaaugggagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacauccgugggaaaauugguacaccagguuuuuggaaccgcauaugguguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacucaaauguggaaguggcauuuuugucacuaaugaaguccacacuuggacagagcaauacaaauuccaagcugacuccccaaaaagacugucagcagccauuggaagggcaugggaggagggcguguguggaauucgaucagccacgcgucuugagaacaucauguggaagcaaauaucaaaugaauugaaccacauucuacuugaaaaugacauaaaauucacagugguuguaggaaaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauacuccagaaugccccgaugaacaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccucguucauagaagucaagacaugcaucuggccgaaaucccacacucuauggaguaauggaguuuuggaaagugaaaugauaaucccaaagauguacggaggaccaauaucucagcacaacuacagaccaggguauuucacacaaacagcagggccauggcaccuaggcaaguuggaauuggauuuugacuugugugaaggaaccacaguuguuguggaugaacauuguggaagucgagguccaucucucagaacuacaacagucacaggaaagauaauccaugaaugguguugcagauccugcacguuaccccccuuacguuucagaggagaagacggauguugguaugguauggaaaucagaccaguuaaggagaaggaggagaaccuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaauggcacaacugacauggaaugaucugauuagguuaugcaucaugguuggagcuaaugcuucagacaagauggggaugggaacaacguaccuagccuugauggcuacuuucaaaaugagaccaauguucgcuguugggcuauuauuucgcagacuaacauccagagaaguucuucuucucacgauuggauuaagccugguggcauccguggagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuacgcauggaagacaacggcuaugguacugucaaucguaucucucuuuccuuuaugccugucuacgaccucucaaaaaacaacauggcuuccggugcuguuaggaucuuuuggaugcaaaccauuaaccauguuucuuauaacagaaaacgaaaucuggggaagaaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgaucuaucauuggagaaagcggcugagguauccugggaagaagaagcagaacacuccgguaccucacacaacauauuaguagagguccaagaugauggaacuaugaaaauaaaagaugaagaaagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcgguucuugaugauggcaucuacagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccaguguaaaaaaggacuugaucucauauggaggagguuggagguuucaaggaucauggaacacgggagaagaagugcaggugauagcuguugaaccagggaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauagcccaagcuaaagcaucacaggaagggccucuaccagagauugaggacgagguguuuaagaaaagaaacuuaacaauaauggaccuccauccaggaucaggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugagcacacaggaagggagauaguugaccucaugugccacgccacuuuuaccaugcgucucuuauccccagugagaguucccaauuacaacaugaucauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaauucaggcuacgacuggaucacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagauggcccagagcguguuauucuagccggaccgaugccagugacuguggccagugcugcccaaaggagaggaagaauuggaaggaaccagaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugauggagaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcauaauuccgaacaaggaggaaaagccuauagacaugcuauggaggaacuaccagacaccauagaaacauugaugcuccuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccugagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaauacuggacguagaccuacauccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggaccuaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccuccugaugcggaccacaugggccuugugugaaucuaucacacuggcuacuggaccccugaccacucuuugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuagugaagcugcacucuggaaaagauguauuuuuuaugccaccugagaaaugugacacccuucugugugauauuggugaguccucuccgaauccaacuauagaagaagguagaacguuacguguucuaaagaugguggaaccauggcucagaggcaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucaugugggacaggaaacauugugucggcagugaacaugacauccagaauguugcugaaucgauucacaauggcucauaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugagguuaagccaucaggaucagccucaucuauggugaauggaguggugagauugcucacaaaaccaugggaugucauccccauggucacacaaauagcuaugacugauaccacacccuuuggacaacagagaguguuuaaagagaagguugacacgcgcacaccaagagcaaaacgaggcacagcacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucacaaacagggaaaaugugccacgugugucuacaacaugauggggaagagagagaaaaaauuaggagaguuuggaaaggcaaaaggaagucgugcaauaugguacauguggcugggagcacgcuuucuggaguucgaggcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugaccuaccaaaacaagguggugagggugcaaagaccagcaaaaaauggaaccgugauggauguuauauccagacgugaccagagaggaaguggacaggucggaacuuauggcuuaaauacuuucacuaauauggagguccaacuaauaagacaaauggagucugaaggaaucuuuuuucccagcgaauuggaaagccccaaucuagcugaaagaguucuugacugguuggaaaaacauggcgccgaaaggcugaaaagaauggcaaucagcggagaugacuguguagugaaaccaauugaugacagauucgcaacagccuuaauagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgcuggauggagccugagagaaacugcuugccuaggcaagucauaugcacaaauguggcagcugauguacuuccacaggagagaccugagacuagcggcuaaugcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguga

SEQ ID NO: 5297 - RNA, 9879 nt, Artificial Sequence
  derived and/or modified CDS sequence (wt) from DENV-1__JX669470__SS-prME
uccgugaccaugcuccucaugcugcugcccacagcccuggcguuccauuugaccacacgagggggagagccacacaugauaguuaguaagcaggaaagaggaaagucacucuuguucaagaccucugcagguguuaauaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacucggucuagaaacaagaaccgaaacauggaugucuucugaaggcgccuggaaacaaauacaaaaaguggagacuugggcuuugagacauccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucgucgaaggacugucaggagcaacguggguagaugugguauuggagcauggaagcugcgucaccaccauggcaaaaaauaaaccaacauuggacauugaacucuugaagacggaggucacgaacccugccgucuugcgcaaacugugcauugaagccaaaauaucaaacaccaccaccgauucaagauguccaacacaaggagaggcuacacugguggaagaacaagacgcgaacuuugugugucgccgaacguuuguggacagaggcugggguaauggcugcggauuauucggaaaaggaagccuauugacgugugccaaguuuaagugugugacaaaacuagaaggaaagauaguucaauaugaaaacuugaaauauucagugauagucaccguccacacuggggaucagcaccaggugggaaacgagaccacagaacauggaacaauugcaaccauaacaccucaagcuccuacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaagaaggagcaaugcacaccgcguugacuggggcgacagaaauccagacgucaggaacgacaacaaucuuugcagggcaccugaaaugcagacuaaaaauggauaaacugacuuuaaaagggaugucauaugugaugugcacaggcucauuuaagcuagagaaggaaguggcugagacccagcauggaacuguucuagugcaggucaaauacgaaggaacagaugcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaauugguacaccagguuuuuggaaccgcauaugguguucuguucagcgguguuucuuggaccaugaaaauaggaauagggauucugcugacaugguugggauuaaauucaaggagcacgucacuuucgaugacgugcauuguaguuggcaugguuacacuguaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaaagacugucagcagccauuggaagggcaugggaggagggcguguguggaauucgaucagccacgcgucuugagaacaucauguggaagcaaauaucaaaugaauugaaccacauucuacuagaaaaugacauaaaauucacagugguuguaggaaaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauacuccagaaugccccgaugaacaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccucguucauagaagucaagacaugcaucuggccgaaaucccacacucuauggaguaauggaguuuuggaaagugaaaugauaaucccaaagauguauggaggaccaauaucucagcacaacuacagaccaggguauuucacacaaacagcagggccauggcaucuaggcaagcuggaauuggauuuugacuugugugaaggaaccacaguuguuguggaugaacauuguggaagucgagguccaucucucagaacuacaacagucacaggaaagauaauccaugaaugguguugcagauccugcacguuaccccccuuacguuucagaggagaagacggauguugguaugguauggaaaucagaccaguuaaggagaaggaggagaaccuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaagauggggaugggaacaacguaccuagccuugauggcuacuuucaaaaugagaccaauguucgcuguugggcuauuauuucgcagacuaacauccagagaaguucuucuucucacgauuggauuaagccugguggcauccguggagcuaccaaauucuuuggaggagcuaggggauggacuugcaauggguaucaugauguuaaaauuauugacugaauuucagccacaucaguuauggaccaccuuacugucucugacauuuaucaaaacaacucuuucauuggauuacgcauggaagacaacggcuaugguacugucaaucguaucucucuuuccuuuaugccugucuacgaccucucaaaaaacaacauggcuuccggugcuguuaggaucuuuuggaugcaaaccauuaaccauguuucucauaacagaaaacgaaaucuggggaagaaaaaguuggccccucaaugaaggaauuauggcuguuggaauagucagcauucuacuaaguucacuccucaaaaaugaugugccguuggccggcccacuaauagcuggaggcaugcuaauagcauguuaugucauauccggaagcucagccgaucuaucauuggagaaagcggcugagguauccugggaagaagaagcagaacacuccgguacaucacacaacauauuaguagagguccaagaugauggaacuaugaaaauaaaagaugaagagagggaugacacacucacuauacuccuuaaagcaaccuugcuggcagucucaggaguguacccaaugucaauaccagcaacucuuuuugugugguaucuuuggcagaaaaagaaacagagaucaggaguguuaugggacacacccagcccuccggaaguggaaagagcgguucuugacgauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauagcccaagcuaaagcaucacaggaagggccucuaccagagauugaggacgagguguucaagaaaagaaacuuaacaauaauggaccuccauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugagcacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaauucaggcuacgacuggaucacugauuuuccagguaaaacagucugguuuguuccaagcauuaaaucaggaaaugacauugccaacugcuuaagaaagaacggaaaacggguaauccaauugagcagaaaaaccuuugacacugaguaccagaaaacaaaaaacaaugacugggacuauguugucacaacagacauuuccgaaaugggggcaaauuuccgggcugacaggguaauagacccaaggcggugcuugaaaccgguaauacuaaaagaugguccagagcguguuauucuagccggaccgaugccagugacuguggccagugcugcccaaaggagaggaagaauuggaaggaaccagaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugauggagaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcauaauuccgaacaaggaggaaaagccuauagacaugccauggaggaacuaccagacaccauagaaacauugaugcuccuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuucuugauggugcugcucauuccagagccagacagacagcgcacuccacaggacaaccagcuagcauauguggugauagguuuguuauucaugauacugacaguggcagccaaugagaugggauuguuggaaaccacaaagaaagaccuggggauuggccauguagccgccgaaaaccaccaacaugcuacaaugcuggacguagaccuacauccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggaccuaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaaucuaucacacuggcuacuggaccccugaccacucuuugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacacuaggagagaaauggaaaagacaguuaaaccaacugagcaagucagaauucaacaccuacaaaaggagugggauuauggagguggacagaucugaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuagugaagcugcacucuggaaaagauguauuuuuuaugccaccugagaaaugugacacccuucugugugauauuggugaguccucuccgaauccaacuauagaagaagguagaacguuacguguucuaaagaugguggaaccauggcucagaggcaaccaauucugcauaaaaauccuaaauccuuacaugccaagugugguagaaacucuggagcaaaugcaaagaaaacauggcgggaugcuagugcgaaacccacucucaagaaauuccacccaugaaauguacuggguuucaugugggacaggaaacauugugucggcagugaacaugacauccagaauguugcugaaucgauucacaauggcucauaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugagguuaagccaucaggaucagccucaucuauggugaauggaguggugagauugcucacaaaaccaugggauguuauccccauggucacacaaauagcuaugacugauaccacacccuuuggacaacagagaguguuuaaagagaagguugacacgcgcacaccaagagcaaaacgaggcacagcacaaauuauggaagugacagccaagugguuaugggguuuccuuuccagaaacaaaaaacccagaaucugcacaagagaggaguucacaagaaagguuaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaggcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucggaaugaggcuaaaaucacugacaucauggagccugaacaugcucuauuggcuacgucaauuuuuaagcugaccuaccaaaacaagguggugagggugcaaagaccagcaaaaaauggaaccgugauggauguuauauccagacgugaccagagaggaaguggacaggucggaacuuauggcuuaaauacuuucacuaauauggagguccaacuaauaagacaaauggagucugaaggaaucuuuuuucccagcgaauuggaaagccccaaucuagcugaaagaguucuugacugguuggaaaaacauggcgccgaaaggcugaaaagaauggcaaucagcggagaugauuguguagugaaaccaauugaugacagauucgcaacagccuuaauagcucugaaugacaugggaaaaguaagaaaagacauaccgcagugggaaccuucaaaaggauggaaugauuggcagcaagugccuuucuguucacaccauuuccaccagcugaucaugaaggaugggagggaaauagugguaccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaaugcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5298 - RNA, 9879 nt, Artificial Sequence
  derived and/or modified CDS sequence (wt) from DENV-1__JX669471__SS-prME
uccgugaccaugcuccucaugcugcugcccacagcccuggcguuccauuugaccacacgagggggagagccacacaugauaguuaguaagcaggaaagaggaaagucacucuuguucaagaccucugcagguguuaauaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacucggucuagaaacaagaaccgaaacauggaugucuucugaaggcgccuggaaacaaauacaaaaaguggagacuugggcuuugagacauccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucgucgaaggacugucaggagcaacguggguagacgugguauuggagcauggaagcugcgucaccaccauggcaaaaaacaaaccaacauuggacauugaacucuugaagacggaggucacgaacccugccgucuugcgcaaacugugcauugaagccaaaauaucaaacaccaccaccgauucaagauguccaacacaaggagaggcuacacugguggaagaacaagacgcgaacuuugugugucgccgaacguuuguggacagaggcugggguaauggcugcggauuauucggaaaaggaagccuauugacgugugccaaguucaagugugugacaaaacuagaaggaaagauaguucaauaugaaaacuugaaauauucagugauagucaccguccacacuggggaucagcaccaggugggaaacgagacuacagaacauggaacaauugcaaccauaacaccucaagcuccuacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaagaaggagcaaugcacaccgcguugacuggggcgacagaaauccagacgucaggaacgacaacaaucuuugcagggcaccugaaaugcagacuaaaaauggauaaacugacuuuaaaagggacgucauaugugaugugcacaggcucauuuaagcuagagaaggaaguggcugagacccagcauggaaccguucuagugcaggucaaauacgaaggaacagaugcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaauugguacaccagguuuuuggaaccgcauaugguguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauuggaagggcaugggaggagggcguguguggaauucgaucagccacgcgucuugagaacaucauguggaagcaaauaucaaaugaauugaaccacauucuacuagaaaaugacauaaaauucacagugguuguaggaaaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauacuccagaaugcccugaugaacaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccucguucauagaagucaagacaugcaucuggccgaaaucccacacucuauggaguaauggaguuuuggaaagugaaaugauuaucccaaagauguauggaggaccaauaucucagcacaacuacagaccaggguauuucacacaaacagcagggccauggcaucuaggcaaguuggaauuggauuuugacuugugugaaggaaccacaguuguuguggaugaacauuguggaagucgagguccaucucucagaacuacaacagucacaggaaagauaauccaugaaugguguugcagauccugcacguuaccccccuuacguuucagaggagaagacggauguugguaugguauggaaaucagaccaguuaaggagaaggaggagaaccuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaagauggggaugggaacaacguaccuagccuugauggcuacucucaaaaugagaccaauguucgcuguugggcugcuauuucgcagacuaacauccagagaaguucuucuucucacgauuggauuaagccugguggcauccguggagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuacgcauggaagacaacggcuaugguacugucaaucguaucucuuuuuccuuuaugccugucuacgaccucucaaaaaacaacauggcuuccggugcuguuaggaucuuuuggaugcaaaccauuaaccauguuucucauaacagaaaacgaaaucuggggaagaaaaaguuggccccucaaugaaggaauuauggcuauuggaauagucagcauccuacuaaguucacuccucaaaaaugaugugccguuggccggcccacuaauagcuggaggcaugcuaauagcauguuaugucauauccggaagcucagccgaucuaucauuggagaaagcggcugagguauccugggaagaagaagcagaacacuccgguaccucacacaacauauuaguagagguccaagaugauggaacuaugaaaauaaaagaugaagagagggaugacacacucacuauacuccuuaaagcaacuuugcuggcagucucgggaguguacccaaugucaauaccagcaacucuuuuugugugguauuuuuggcagaaaaagaaacagagaucaggaguguuaugggacacaccuagcccuccggaaguggaaagagcuguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugcuauagcccaagcuaaagcaucacaggaagggccucuaccagagauugaggacgagguguuuaagaaaagaaacuuaacaauaauggaccuccauccaggaucaggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugagcacacaggaagggagauaguugaccucaugugccacgccacuuuuaccaugcgucucuuauccccagugagaguucccaauuacaauaugauuauuauggaugaagcacauuuuaccguuccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaauucaggcuacgacuggaucacugauuuuccagguaaaacagucugguuuguuccaagcauuaaaucaggaaaugacauugccaacugcuuaagaaagaacggaaaacggguaauccaauugagcagaaaaaccuuugacacugaguaccagaaaacaaaaaacaaugacugggacuauguugucacaacagacauuuccgaaaugggggcaaauuuccgggcugacaggguaauagacccaaggcggugcuugaaaccgguaauacuaaaagaugguccagagcguguuauucuagccggaccgaugccagugacuguggccagugcugcccaaaggagaggaagaauuggaaggaaccagaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugauggagaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcaaagagcccagaaugcucuggauaacuuggucauguugcauaauuccgaacaaggaggaaaagccuauagacaugccauggaggaacuaccagacaccauagaaacauugaugcuccuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacauccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggaccuaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaaucuaucacacuggcuacuggaccccugaccacucuuugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacacuaggagagaaauggaaaagacaguuaaaccaacugagcaagucagaauucaacaccuacaaaaggagugggauuauggagguggacagaucugaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaagcugcacucuggaaaagauguauuuuuuaugccuccugagaaaugugacacccuucugugugauauuggugaguccucuccgaauccaacuauagaagaagguagaacguuacguguucuaaagaugguggaaccauggcucagaggcaaccaauucugcauaaaaauccuaaauccuuacaugccaagugugguagaaacucuggagcaaaugcaaagaaaacauggcgggaugcuagugcgaaacccacucucaagaaauuccacccaugaaauguacuggguuucaugugggacaggaaacauugugucggcagugaacaugacauccagaauguugcugaaucgauucacaauggcucauaggaagccaacauaugacagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugagguuaagccaucaggaucagccucaucuauggugaauggaguggugagauugcucacaaaaccaugggauguuauccccauggucacacaaauagcuaugacugauaccacacccuuuggacaacagagaguguuuaaagagaagguugacacgcgcacaccaagagcaaaacgaggcacagcacaaauuauggaagugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagccgugcaauaugguacauguggcugggagcacgcuuucuggaguucgaggcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugaccuaccaaaacaagguggugagggugcaaagaccagcaaaaaauggaaccgugauggaugucauauccagacgugaucagagaggaaguggacaggucggaacuuauggcuuaaauacuuucacuaauauggagguccaacuaauaagacaaauggagucugaaggaaucuuuuuucccagcgaauuggaaagccccaaucuagcugaaagaguucuugacugguuggaaaaacauggcgccgaaaggcugaaaagaauggcaaucagcggagaugauuguguagugaaaccaauugaugacagauucgcaacagccuuaauagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaaugcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5299 - RNA, 9879 nt, Artificial Sequence
  derived and/or modified CDS sequence (wt) from DENV-1__JX669472__SS-prME
uccgugaccaugcuccucaugcugcugcccacagcccuggcguuccauuugaccacacgagggggagagccacacaugauaguuaguaagcaggaaagaggaaagucacucuuguucaagaccucugcagguguuaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacucggucuagaaacaagaaccgaaacauggaugucuucugaaggcgccuggaaacaaauacaaaaaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucgucgaaggacugucaggagcaacguggguagacgugguauuggagcauggaagcugcgucaccaccauggcaaaaaauaaaccaacauuggacauugaacucuugaagacggaggucacgaacccugccgucuugcgcaaacugugcauugaagccaaaauaucaaacaccaccaccgauucaagauguccaacacaaggagaggcuacacugguggaagaacaagacgcgaacuuugugugucgccgaacguuuguggacagaggcugggguaauggcugcggauuauucggaaaaggaagccuauugacgugugccaaguucaagugugugacaaaacuagaaggaaagauaguucaauaugaaaacuuaaaauauucagugauagucaccguccacacuggggaucagcaccaggugggaaacgagacuacagaacauggaacaauugcaaccauaacaccucaagcuccuacaucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaagaaggagcaaugcacaccgcguugacuggggcgacagaaauccagacgucaggaacgacaacaaucuuugcagggcaccugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagaugcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaacugcccgaggagcacgaaggauggcuauccugggagacaccgcaugggacuucggcucuauaggaggaguguucacaucugugggaaaauugguacaccagguuuuuggaaccgcauaugguguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauuggaagggcaugggaggagggcguguguggaauucgaucagccacgcgucuugagaacaucauguggaagcaaauaucaaaugaauugaaccacauucuacuagaaaaugacaugaaauucacagugguuguaggaaaugcuaauggaauuuuggcccaagggaaaaaaaugauuaagccacaacccauggaacacaaauacucauggaaaagcuggggaaaagcuaaaaucauaggagcagacauacaaaauaccaccuucaucaucgacggcccagauacuccagaaugcccugaugaacaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccucguucauagaagucaagacaugcaucuggccgaaaucccacacucuauggaguaauggaguuuuggaaagugaaaugauaaucccaaagauguauggaggaccaauuucucagcacaacuacagaccaggguauuucacacaaacagcagggccauggcaucuaggcaaguuggaauuggauuuugacuugugugaaggaaccacaguuguuguggaugaacauuguggaagucgagguccaucucucagaaccacaacagucacaggaaagauaauccaugaaugguguugcagauccugcacguuaccccccuuacguuucagaggagaagacggauguugguaugguauggaaaucagaccaguuaaggagaaggaggagaaccuaguuaggucaauggucucugcagggucaggagaaguagacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaagauggggaugggaacaacguaccuagccuugauggcuacuuucaaaaugagaccaauguucgcuguugggcuauuauuucgcagacuaacauccagagaaguucuucuucucacgauuggauuaagccugguggcauccguggagcuaccaaauucuuuggaggagcuaggggauggacuugcaauggguaucaugauguuaaaauuauugacugaauuucagccacaccaguuauggacuaccuuacuuucucugacauuuaucaaaacaacucuuucauuggauuacgcauggaagacaacggcuacgguacugucaaucguaucucucuuuccuuuaugccugucuacgaccucucaaaaaacaacauggcuuccagugcuguuaggaucuuuuggaugcaaaccauuaaccauguuucucauaacagaaaacaaaaucuggggaagaaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgaucuaucauuggagaaagcggcugagguaucaugggaagaagaagcagaacacuccgguaccucacacaacauauuaguagagguucaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcgguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacaggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauagcccaagcuaaagcaucacaggaagggccucuaccagagauugaggacgagguguuuaagaaaagaaacuuaacaauaauggaccuccauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugagcacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaauucaggcuacgacuggaucacugauuuuccagguaaaacagucugguuuguuccaagcauuaaaucaggaaaugacauugccaacugcuuaagaaagaacggaaaacggguaauccaauugagcagaaaaaccuuugacacugaguaccagaaaacaaaaaacaaugacugggacuauguugucacaacagacauuucugaaaugggggcaaauuuccgggcugacaggguaauagacccaaggcggugcuugaaaccgguaauacuaaaagaugguccagagcguguuauucuagccggaccgaugccagugacuguggccagugcugcccaaaggagaggaagaauuggaaggaaccagaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcgaggaaaacguucguggagcucaugagaagaggagaucuaccaguuuggcuauccuacaaaguugccucagaagguuuccaguacuccgacagaagguggugcuuugauggagaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcauaauuccgaacaaggaggaaaagccuauagacaugccauggaggaacuaccagacaccauagaaacauugaugcuccuagcuuugauagcuguguugacugguggagugacgcuguucuuccuaucaggaaaaggucuagggaaaacauccauuggcuugcucugugugacggccucaagcgcacugcuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgcagaaaaccaccaacaugcuacaaugcuggacguagacuuacauccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggaccuaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaaucuaucacacuggcuacuggaccccugaccacucuuugggagggaucuccgggaaaauucuggaauaccacgauagcaguauccauggcaaacaucuucaggggaaguuaucuagcaggagcaggucuggccuucucauuaaugaaaucuuuaggaggagguaggagagguacgggagcucaaggggaaacauuaggagagaaauggaaaagacaguuaaaccaacugagcaagucagaauucaacaccuacaaaaggagugggaucauggagguggacagaucugaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuagugaagcugcacucuggaaaagauguauuuuuuaugccaccugagaaaugugacacccuucugugugauauuggugaguccucuccaaauccaacuauagaagaagguagaacgcuacguguucuaaagaugguggaaccauggcucagaggcaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucaugugggacaggaaacauugugucggcagugaacaugacauccagaauguugcugaaucgauucacaauggcucauaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugagguuaagccaucaggaucagccucaucuauggugaauggaguggugagauugcucacaaaaccaugggauguuauccccauggucacacaaauagcuaugacugauaccacacccuuuggacaacagagaguguuuaaagagaagguugacacgcgcacaccaagagcaaaacgaggcacagcacaaauuauggaagugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaggcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugaccuaccaaaacaagguggugagggugcaaagaccagcaaaaaauggaaccgugauggauguuauauccagacgugaccagagaggaaguggacaggucggaacuuauggcuuaaauacuuucacuaauauggagguccaacuaauaagacaaauggagucugagggaaucuuuuuucccagcgaauuggaaagccccaaucuagcugaaagaguucuugacugguuggaaaaacauggcgccgaaaggcugaaaagaauggcaaucagcggagaugauuguguagugaaaccaauugaugacagauucgcaacagccuuaauagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaaugcuaucuguucagccgucccaguugauugggucccaaccagccgcacaaccuggucaauccaugcccaccaccaauggaugacaacagaagacauguuaucaguguggaacaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5300 - RNA, 9879 nt, Artificial Sequence
  derived and/or modified CDS sequence (wt) from DENV-1__JX669473__SS-prME
uccgugaccaugcuucucaugcugcugcccacagcccuggcguuccauuugaccacacgaggaggagagccacacaugauaguuaguaagcaggaaagaggaaagucacucuuguucaagaccucugcaggugucaauaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacucggucuagaaacaagaacugaaacauggaugucuucugaaggcgccuggaaacaaauacaaaaaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucgucgaaggacugucaggagcaacguggguagacgugguauuggagcauggaagcugcgucaccaccauggcaaaaaauaaaccaacauuggacauugaacucuugaagacggaggucacgaacccugccgucuugcgcaaacugugcauugaagccaaaauaucaaacaccaccaccgauucaagauguccaacacaaggagaggcuacacugguggaagaacaagacgcgaacuuugugugucgccgaacguuuguggacagaggcugggguaauggcugcggauuauucggaaaaggaagccuauugacgugugccaaguucaagugugugacaaaacuagaaggaaagauaguucaauaugaaaacuuaaaauauucagugauagucaccguccacacuggggaucagcaccaggugggaaacgagacuacagaacauggaacaauugcaaccauaacaccucaagcucccucgucggaaauacagcugacugacuacggagcccucacauuggacugcucaccuaggacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaagaaggagcaaugcacaccgcguugacuggggcgacagaaauccagacgucaggaacgacaacaaucuuugcagggcaccugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagaugcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgcaggauggcuauccugggagacaccgcaugggacuucggcucuauaggaggaguguucacaucugugggaaaauugguacaccagguuuuuggaaccgcauaugguguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauuggaagggcaugggaggagggcguguguggaauucgaucagccacgcgucuugagaacaucauguggaagcaaauaucaaaugaauugaaccacauucuacuagaaaaugacaugaaauucacagugguuguaggaaaugcuaauggaauuuuggcccaagggaaaaaaaugauuaagccacaacccauggaacacaaauacucauggaaaagcuggggaaaagcuaaaaucauaggagcagacauacaaaaugccaccuucaucaucgauggcccagauacuccagaaugcccugaugaacaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccucguucauagaagucaagacaugcaucuggccgaaaucccacacucuauggaguaauggaguuuuggaaagugaaaugauaaucccaaagauguauggaggaccaauaucucagcacaacuacagaccaggguauuucacacaaacagcagggccauggcaucuaggcaaguuggaauuggauuuugacuugugugaaggaaccacaguuguuguggaugaacauuguggaagucgagguccaucucucagaaccacaacagucacaggaaagauaauccaugaaugguguugcagauccugcacguuaccccccuuacguuucagaggagaagacggauguugguaugguauggaaaucagaccaguuaaggagaaggaggagaaccuaguuaggucaauggucucugcagggucaggagaaguagacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaagauggggaugggaacaacguaccuagccuugauggcuacuuucaaaaugagaccaauguucgcuguugggcuauuauuucgcagacuaacauccagagaaguucuucuucucacgauuggauuaagccugguggcauccguggagcuaccaaauucuuuggaggagcuaggggauggacuugcaauggguaucaugauguuaaaauuauugacugaauuucagccacaccaguuauggaccaccuuacuuucucugacauuuaucaaaacaacucuuucauuggauuacgcauggaagacaacggcuacgguacugucaaucguaucucucuuuccuuuaugccugucuacgaccucucaaaaaacaacauggcuuccagugcuguuaggaucuuuuggaugcaaaccauuaaccauguuucucauaacagaaaacaaaaucuggggaagaaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgaucuaucauuggagaaagcggcugagguauccugggaagaagaagcagaacacuccgguaccucacacaacauauuaguagagguucaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcgguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacaggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauagcccaagcuaaagcaucacaggaagggccucuaccagagauugaggacgagguguuuaagaaaagaaacuuaacaauaauggaccuccauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugagcacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggcuuuuccacagagcaaugcaguuauccaagaugaggaaagagacauuccugagagaucauggaauucaggcuacgacuggaucacugauuuuccagguaaaacagucugguuuguuccaagcauuaaaucaggaaaugacauugccaacugcuuaagaaagaacggaaaacggguaauccaauugagcagaaaaaccuuugacacugaguaccagaaaacaaaaaacaacgacugggacuauguugucacaacagacauuucugaaaugggggcaaauuuccgggcugacaggguaauagacccaaggcggugcuugaaaccgguaauacuaaaagaugguccagagcguguuauucuagccggaccgaugccagugacuguggccagugcugcccaaaggagaggaagaauuggaaggaaccagaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcgaggaaaacguucguggagcucaugagaagaggagaucuaccaguuuggcuauccuacaaaguugccucagaagguuuccaguacuccgacagaagguggugcuuugauggagaaaggaacaaccagguguuggaggagaacauggacguggagaucuggacaaaggaaggagaaagaaagaaauugcgaccccgcugguuggaugcuagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcuguguugacugguggagugacguuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagacuuacauccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggaccuaggaguuccacuucucgccuuagggugcuauucccaggugaacccauugacacugacagcagcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaaucuauuacacuggcuacuggaccccugaccacucuuugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacauuaggagagaaauggaaaagacaguuaaaccaacugagcaagucagaauucaacaccuacaaaaggagugggaucauggagguggacagaucugaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaaaggauacacaaaaggaggaccuggacaugaggaacccaucccaauggcgaccuauggauggaaccuagugaagcugcacucuggaaaagauguauuuuuuaugccaccugagaaaugugacacccuucugugugauauuggugaguccucuccaaauccaacuauagaagaagguagaacgcuacguguucuaaagaugguggaaccauggcucagaggcaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucaugugggacaggaaacauugugucggcagugaacaugacauccagaauguugcugaaucgauucacaauggcucauaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugagguuaagccaucaggaucagccucaucuauggugaauggaguggugagauugcucacaaaaccaugggauguuauccccauggucacacaaauagcuaugacugauaccacacccuuuggacaacagagaguguuuaaagagaagguugacacacgcacaccaagagcaaaacgaggcacagcacaaauuauggaagugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaggcccuugguuucaugaaugaagaccacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugaccuaccaaaacaagguggugagggugcaaagaccagcaaaaaauggaaccgugauggauguuauauccagacgugaccagagaggaaguggacaggucggaacuuauggcuuaaauacuuucacuaauauggagguccaacuaauaagacaaauggagucugaaggaaucuuuuuucccagcgaauuggaaagccccaaucuagcugaaagaguucuugacugguuggaaaaacauggcgcugaaaggcugaaaagaauggcaaucagcggagaugauuguguagugaaaccaauugaugauagauucgcaacagccuuaauagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaaugcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggagcacucugguaa

SEQ ID NO: 5301 - RNA, 9879 nt, Artificial Sequence
  derived and/or modified CDS sequence (wt) from DENV-1__JX669474__SS-prME
uccgugaccaugcuucucaugcugcugcccacagcccuggcguuccauuugaccacacgaggaggagagccacacaugauaguuagcaagcaggaaagaggaaagucacucuuguucaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacucggucuagaaacaagaacugaaacauggaugucuucugaaggcgccuggaaacaaauacaaaaaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucgucgaaggacugucaggagcaacguggguagacgugguauuggagcauggaagcugcgucaccaccauggcaaaaaauaaaccaacauuggacauugaacucuugaagacggaggucacgaacccugccgucuugcgcaaacugugcauugaagccaaaauaucaaacaccaccaccgauucaagauguccaacacaaggagaggcuacacugguggaagaacaagacgcgaacuuugugugucgccgaacguuuguggacagaggcugggguaauggcugcggauuauucggaaaaggaagccuauugacgugugccaaguucaagugugugacaaaacuagaaggaaagauaguucaauaugaaaacuuaaaauauucagugauagucaccguccacacuggggaucagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaagaaggagcaaugcacaccgcguugacuggggcgacagaaauccagacgucaggaacgacaacaaucuuugcagggcaccugaaaugcagacuaaaaauggauaaacugacuuuaaaggggaugucauaugugaugugcacaggcucauuuaagcuagagaaggaaguggcugagacccagcauggaacuguucuagugcaggucaaauacgaaggaacagaugcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaauugguacaccagguuuuuggaaccgcauaugguguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauuggaagggcaugggaggagggcguguguggaauucgaucagccacgcgucuugagaacaucauguggaagcaaauaucaaaugaauugaaccacauucuacuagaaaaugacaugaaauucacagugguuguaggaaaugcuaauggaauuuuggcccaagggaaaaaaaugauuaagccacaacccauggaacacaaauacucauggaaaagcuggggaaaagcuaaaaucauaggagcagacauacaaaaugccaccuucaucaucgauggcccagauacuccagaaugcccugaugaacaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccucguucauagaagucaagacaugcaucuggccgaaaucccacacucuauggaguaauggaguuuuggaaagugaaaugauaaucccaaagauguauggaggaccaacaucucagcacaacuacagaccaggguauuucacacaaacagcagggccauggcaucuaggcaaguuggaauuggacuuugacuugugugaaggaaccacaguuguuguggaugaacauuguggaagucgagguccaucucucagaaccacaacagucacaggaaagauaauccaugaaugguguugcagauccugcacguuaccccccuuacguuucagaggagaagacggaugcugguaugguauggaaaucagaccaguuaaggagaaggaggagaaccuaguuaggucgauggucucugcagggucaggagaaguagacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaagauggggaugggaacaacguaccuagccuugauggcuacuuucaaaaugagaccaauguucgcuguugggcuauuguuucgcagacuaacauccagagaaguucuucuucucacgauuggauuaagccugguggcauccguggagcuaccaaauucuuuggaggagcuaggggauggacuugcaauggguaucaugauguuaaaauuauugacugaauuucagccacaccaguuauggaccaccuuacuuucucugacauuuaucaaaacaacucuuucauuggauuacgcauggaagacaacggcuacgguacugucaaucguaucucucuuuccuuuaugccugucuacgaccucucaaaaaacaacauggcuuccagugcuguuaggaucuuuuggaugcaaaccauuaaccauguuucucauaacagaaaacgaaaucuggggaagaaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgaucuaucauuggagaaagcggcugagguauccugggaagaagaagcagaacacuccgguaccucacacaacauauuaguagagguucaagaugauggaacuaugaaaauaaaagaugaagagagggaugacacacucacuauacuccuuaaagcaacuuugcuggcaaucucaggaguguacccaaugucaauaccagcaacucuuuuugugugguauuuuuggcagaaaaagaaacagagaucaggaguguuaugggacacacccagcccuccggaaguggaaagagcgguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacaggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauagcccaagcuaaagcaucacaggaagggccucuaccagagauugaggacgagguguuuaagaaaagaaacuuaacaauaauggaccuccauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugagcacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggcuuuuccacagagcaaugcaguuauccaagaugaggaaagagacauuccugagagaucauggaauucaggcuacgacuggaucacugauuuuccagguaaaacagucugguuuguuccaagcauuaaaucaggaaaugacauugccaacugcuuaagaaagaacggaaaacggguaauccaauugagcagaaaaaccuuugacacugaguaccagaaaacaaaaaacaaugauugggacuauguugucacaacagacauuucugaaaugggggcaaauuuccgggcugacaggguaauagacccaaggcggugcuugaaaccgguaauacuaaaagaugguccagagcguguuauucuagccggaccgaugccagugacuguggccagugcugcccaaaggagaggaagaauuggaaggaaccagaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcgaggaaaacguucguggagcucaugagaagaggagaucuaccaguuuggcuauccuacaaaguugccucagaagguuuccaguacuccgacagaagguggugcuuugauggagaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaauuuggucauguugcacaauuccgaacaaggaggaaaagccuauagacaugcuauggaggaacuaccagacaccauagaaacauugaugcuccuggccuugauagcuguguugacugguggagugacguuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagacuuacauccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggaccuaggaguuccacuucucgccuuagggugcuauucucaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaaucuauuacacuggcuacuggaccccugaccacucuuugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacauuaggagagaaauggaaaagacaguuaaaccaacugagcaagucagaauucaacaccuacaaaaggagugggaucauggagguggacagaucugaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccaaucccaauggcgaccuauggauggaaccuagugaagcugcacucuggaaaagauguauuuuuuaugccaccugagaaaugugacacccuucugugugauauuggugaguccucuccaaauccaacuauagaagaagguagaacgcuacguguucuaaagaugguggaaccauggcucagaggcaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucaugugggacaggaaacauugugucggcagugaacaugacauccagaauguugcugaaucgauucacaauggcucauaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugagguuaagccaucaggaucagccucaucuauggugaauggaguggugagauugcucacaaaaccaugggauguuauccccauggucacacaaauagcuaugacugauaccacacccuuuggacaacagagaguguuuaaagagaagguugacacgcgcacaccaagagcaaaacgaggcacagcacaaauuauggaagugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaggcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugaccuaccaaaacaagguggugagggugcaaagaccagcaaaaaauggaaccgugauggauguuauauccagacgugaccagagaggaaguggacaggucggaacuuauggcuuaaauacuuucacuaauauggagguccaacuaauaagacaaauggagucugaaggaaucuuuuuucccagcgaauuggaaagccccaaucuagcugaaagaguucuugacugguuggaaaaacauggcgccgaaaggcugaaaagaauggcaaucagcggagaugauuguguagugaaaccaauugaugacagauucgcaacagccuuaauagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggagccggauggagccugagagaaacugcuugccuaggcaagucauaugcacaaauguggcagcugauguacuuccacaggagagaccugagacuggcagcuaaugcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5302 - RNA, 9879 nt, Artificial Sequence
  derived and/or modified CDS sequence (wt) from DENV-1__JX669475__SS-prME
uccgugaccaugcuccucaugcugcugcccacagcccuggcguuccauuugaccacacgagggggagagccacacaugauaguuaguaagcaggaaagaggaaagucacucuuguucaagaccucugcagguguuaauaugugcacucuuauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacucggucuagaaacaagaaccgaaacauggaugucuucugaaggcgccuggaaacaaauacaaaaaguggagacuugggcuuugagacauccaggauucacggugauagcccuuuuuuuagcacaugccauaggaacauccaucacucagaaagggaucauuuucauuuugcugaugcuggugacaccaucaauggccaugcgaugcgugggaauaggcaauagagacuucgucgaaggacugucaggagcaacguggguagacgugguauuggagcauggaagcugcgucaccaccauggcaaaaaauaaaccaacauuggacauugaacucuugaagacggaggucacgaacccugccgucuugcgcaaacugugcauugaggccaaaauaucaaacaccaccaccgauucaagauguccaacacaaggagaggcuacacugguggaagaacaagacgcgaacuuugugugucgccgaacguuuguggacagaggcugggguaauggcugcggauuauucggaaaaggaagccuauugacgugugccaaguucaagugugugacaaaacuagaaggaaagauaguucaauaugaaaacuugaaauauucagugauagucaccguccacacuggggaucagcaccaggugggaaacgagacuacagaacauggaacaauugcaaccauaacaccucaagcuccuacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaagaaggagcaaugcacaccgcguugacuggggcgacagaaauccagacgucaggaacgacaacaaucuuugcagggcaccugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagaugcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaauugguacaccaaguuuuuggaaccgcauaugguguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaaaggcagagaacucaaauguggaaguggcauuuuugucacuaaugaaguccacacuuggacagagcaauacaaauuccaggcugacuccccaaaaagacugucagcagccauuggaaaggcaugggaggagggcguguguggaauccgaucagccacgcgucuugagaacaucauguggaagcaaauaucaaaugaauugaaccacauucuacuagaaaaugacauaaaauucacagugguuguaggaaaugcuaauggaauuuuggcucaaggaaaaaaaaugauuaggccacaacccauggaacacaaauacucauggaaaagcuggggaaaagcuaaaaucauaggagcagacauacaaaacaccaccuucaucaucgacggcccagauacuccagaaugcccugaugaacaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccucguucauagaagucaagacaugcaucuggccgaaaucccacacucuauggaguaauggaguuuuggaaagugaaaugauaaucccaaagauguauggaggaccaauaucucagcacaacuacagaccaggguauuucacacaaacagcagggccauggcaucuaggcaaguuggaauuggauuuugacuugugugaaggaaccacaguuguuguggaugaacauuguggaagucgagguccaucucucagaacuacaacagucacaggaaagauaauccaugaaugguguugcagauccugcacguuaccccccuuacguuucagaggagaagacggauguugguaugguauggaaaucagaccaguuaaggagaaggaggagaaccuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaagauggggaugggaacaacguaccuagccuugauggcuacuuucaaaaugagaccaauguucgcuguugggcuaucauuucgcagacuaacauccagagaaguucuucuucucacgauuggauuaagccugguggcauccguggagcuaccaaacucuuuggaggagcuaggggauggacuugcaauggguaucaugauguuaaaauuauugacugaauuucagccacaccaguuauggaccaccuuacugucucugacauuuaucaaaacaacucuuucauuggauuacgcauggaagacaacggcuaugguacugucaaucguaucucucuuuccuuuaugccugucuacgaccucucaaaaaacaacauggcuuccggugcuguuaggaucuuuuggaugcaaaccauuaaccauguuucucauaacagaaaacgaaaucuggggaagaaaaagcuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgaucuaucauuggagaaagcggcugagguauccugggaagaagaagcagaacacuccgguaccucacacaacauauuaguagagguccaagaugauggaacuaugaaaauaaaagaugaagagagggaugacacacucacuauacuccuuaaagcaacuuugcuggcagucucgggaguguacccaaugucaauaccagcaacucuuuuugugugguauuuuuggcagaaaaagaaacagagaucagggguguuaugggacacacccagcccuccggaaguggaaagagcgguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccaguguaaaaaaagacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauagcccaagcuaaagcaucacaggaagggccucuaccagagauugaggacgagguguuuaggaaaagaaacuuaacaauaauggaccuccauccaggaucaggaaaaacaagaagauaucuuccagccauaguccgugaggccauaaaaaggaaacugcgcacguuaaucuuggcucccacaagaguugucgccucugaaauggcagaggcgcucaaaggaaugccaauaagauaucagacaacagcagugaagagugagcacacaggaagggagauaguugaccucaugugccacgccacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccgggaucgguggaggccuuuccacagagcaaugcaguuauccaagaugaggaaagagacauuccugagagaucauggaauucaggcuacgacuggaucacugauuuuccagguaaaacagucugguuuguuccaagcauuaaaucaggaaaugacauugccaacugcuuaagaaagaacggaaaacggguaauccaauugagcagaaaaaccuuugacacugaauaccagaaaacaaaaaacaaugacugggacuauguugucacaacagacauuuccgaaaugggggcaaauuuccgggcugacaggguaauagacccaaggcggugcuugaaaccgguaauacuaaaagaugguccagagcguguuauuuuagccggaccgaugccagugacuguggccagugcugcccaaaggagaggaagaauuggaaggaaccagaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugauggagaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcauaauuccgaacaaggaggaaaagccuauagacaugccauggaggaacuaccagacaccauagaaacauugaugcuccuagccuugauagcuguguugacugguggagugacgcuguucuuccuaucaggaaaaggucuagggaaaacauccauuggcuugcucugugugacggccucaagcgcacuguuauggauggccaguguggaaccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuguuggaaaccacaaagaaagaccuggggauuggccauguagccgccgaaaaccaccaacaugcuacaaugcuggacguagaccuacauccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggaccuaggaguuccacuucucgccuuagggugcuauucccaggugaauccauugacacugacagcggcgguguugauguuaguggcucauuaugccauaauuggaccaggacugcaagcaaaggccacuagagaagcucaaaaaaggacagcagccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaaucuaucacacuggcuacuggaccccugaccacucuuugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacacuaggagagaaauggaaaagacaguuaaaccaacugagcaagucagaauucaacaccuacaaaaggagugggauuauggagguggacagaucugaagccaaagagggacugaaaagaggagaaacaaccaaacaugcagugucgagaggaacagccaaacugaggugguuuguggagaggaaccucgugaaaccagaagggaaggucauagaccucgguuguggaagagguggcuggucauauuauugugcugggcugaagaaagucacugaagugaagggauacacaaaaggaggaccuggacaugaggaacccaucccaauggcgaccuauggauggaaccuagugaagcugcacucuggaaaagauguauuuuuuaugccaccugagaaaugugacacccuucugugugauauuggugaguccucuccgaauccaacuauagaagaagguagaacguuacguguucuaaagaugguggaaccauggcucagaggcaaccaauucugcauaaaaauccuaaauccuuacaugccaagugugguagaaacucuggagcaaaugcaaagaaaacauggcgggauguuagugcgaaacccacucucaagaaauuccacccaugaaauguacuggguuucaugugggacaggaaacauugugucggcagugaacaugacauccagaauguugcugaaucgauuuacaauggcucauaggaagccaacauaugaaagagacguggacuuaggcgcuggaacaagacauguagcaguggaaccagagguagccaaccuagauaucauuggccagaggauagagaauauaaaaaaugaacacaagucaacauggcauuaugaugaagacaauccauacaaaacaugggccuaucauggaucauaugaggucaagccaucaggaucagccucaucuauggugaauggaguggugagauugcucacaaaaccaugggaugucauccccauggucacacaaauagcuaugacugacaccacacccuuuggacaacagagaguguuuaaagagaagguugacacgcgcacaccaagagcaaaacgaggcacagcacaaauuauggaagugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaagggagucgugcaauaugguacauguggcugggagcacgcuuucuggaguucgaggcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugaccuaccaaaacaagguggugaggguacaaagaccagcaaaaaauggaaccgugauggauguuauauccagacgugaccagagaggaaguggacaggucggaacuuauggcuuaaauacuuucacuaauauggagguccaacuaauaagacaaauggagucugaaggaaucuuuuuucccagcgaauuggaaagccccaaucuagcugaaagaguucuugacugguuggaaaaacauggcgccgaaaggcugaaaagaauggcaaucagcggagaugacuguguagugaaaccaauugaugacagauucgcaacagcauuaauagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaucaagaugaacuugugggcagggcuagaguaucacaaggcgccggauggagccugagagaaacugcuugccuaggcaagucauaugcacaaauguggcagcugauguacuuccacaggagagaccugagacuagcggcuaaugcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaagucccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggggcacucugguga

SEQ ID NO: 5303 - RNA, 9879 nt, Artificial Sequence
  derived and/or modified CDS sequence (wt) from DENV-1__JX669461__SS-prME
uccgugaccaugcuccucaugcugcugcccacagcccuggccuuccauuugaccacacgagggggagagccacacaugauagucagcaagcaggaaagaggaaagucacucuuguuuaagaccucuguaggugucaacaugugcacucucauugcgauggauuugggagaguuaugugaggacacaaugaccuacaaaugcccccggaucacugaggcggaaccagaugauguugacugcuggugcaaugccacagacacaugggugaccuaugggacguguucucaaaccggcgaacaccgacgagacaaacguuccgucgcacuggccccacacgugggacuuggucuagaaacaagaacugaaacguggaugucaucugaaggcgccuggaaacaaauacaaaaaguggagacuugggcuuugcgacacccaggauucacggugauagcccuuuucuuggcacaugccauaggaacauccaucacccagaaagggaucauuuucauuuugcugaugcugguaacaccaucaauggccaugcgaugcgugggaauaggcaauagagacuucguugaaggacugucaggagcaacguggguggacgugguacuggagcauggaagcugcgucaccaccauggcaaaaaacaaaccaacauuggacauugaacucuugaaaacggaggucacgaacccugccguccugcgcaaacugugcauugaagcuaaaauaucaaacaccaccaccgauucaagauguccaacacaaggagaagccacacugguggaagaacaagacgcgaacuuugugugucgacggacguucguggacagaggcugggguaauggcugcggacuauuuggaaaaggaagucuacugacgugugcuaaguucaagugugugacaaaacuagaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagacuuaccacugccuuggacuucgggagcuucaacaucccaagagacuuggaacagacaagauuugcuggucacauucaagacagcucaugcaaagaaacaggaaguagucgugcugggaucacaggaaggagcaaugcacacugcgcugacuggggcgacagaaauccagacgucaggaacgacaacaauuuuugcgggacaccugaaauguagacuaaaaauggacaaacugacuuuaaaagggaugucauaugugaugugcacaggcucauuuaagcuggagaaggaaguggcugagacccagcauggaacuguuuuagugcagguuaaauacgaaggaacagaugcaccaugcaagaucccuuuuuugacccaagaugagaaaggagugacccagaaugggagauugauaacagccaauccuauaguuacugauaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggccauccugggagacacugcaugggacuucggcucuauaggaggauuguucacgucugugggaaaauugauacaccagguuuuuggaacugcauaugggguucuguucagcgguguuucuuggaccaugaaaauaggaauagggauucugcugacaugguugggauuaaauucaaggagcacgucacuuucaaugacgugcauugcaguuggcauggucacgcuguaccuaggagucaugguucaagcggacucgggaugugugaucaacuggaagggcagagaacucaaauguggaaguggcaucuuugucacuaaugaaguccacacuuggacagagcaauauaaauuccaggcugacuccccaaaaagacugucagcagccauugggaaggcaugggaggaaggcguguguggaauucgaucagccacgcgucuugagaacaucauguggaagcaaauaucaaaugaauugaacuacauccuacuugaaaaugacaugaaauucacagugguuguaggagacguuaauggaauuuuggcccaagggaaaaaaaugauuagaccacaacccauggaacacaaauacucauggaaaaguuggggaaaagcuaagaucauaggagcagacauacagaacaccaccuuuaucauugacggcccagauacuccagaaugucccgaugaccaaagagcauggaacauuugggaaguugaggacuacggguucggaauuuucacgacaaacauauggcugaaauugcgugacucccacacccaaaugugugaccaucggcuaaugucagcugccaucaaggacagcaaagcaguccaugcugauauggguuacuggauagaaagugaaaagaacgagaccuggaagcuagcgagagccuccuuuauagaagucaagacaugcaucuggccgaaaucccacacucuauggaguaauggaguuuuggaaagugaaaugguaaucccaaagauauauggaggaccaauaucucagcacaacuacagaccaggguauuucacacaaacagcagggccauggcaccuaggcaaguuggaauuggauuuugacuugugugaagguaccacaguuguuguagaugaacauuguggauaucgaggcccaucucucagaacuacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaauggacaguuuuucauuaggaauacuaugcguaucaauacugauugaagaaguaaugagauccagauggaguagaaagaugcugaugacuggaacacuggcuguuuuccuccuucucauaaugggacaacugacauggaaugaucugauuagguuaugcaucaugguuggagcuaaugcuucagacaagauggggaugggaacaacguaccuagccuugauggcuacucucaaaaugagaccaauguucgcuguugggcuauuauuucgcagacuaacauccagagaaguucuucuucucacgguuggauuaagccugguugcauccguggagcuaccaaauucuuuagaggagcuaggggauggacuugcaaugggcaucaugauguuaaaauuauugacugacuuccagccacaccaguuauggaccacccuauugucucuaacauuuaucagaacaucucuuucauuggauuaugcauggaagacaauggcuauggcacugucaaucguaucucucuuuccuuugugucugucuacgaccucccaaaaaacaacauggcuuccggugcuguuaggaucuuuuggaugcaaaccauuaaccauguuucucauaacagaaaacaaaaucuggggaaggaaaagcuggcccaucaaugaaggaauuauggcuguuggaauagucagcauucuacuaaguucacuccucaaaaaugaugugccgcuagccggcccacuaauagcuggaggcaugcuaauagcauguuaugucauaucuggaagcucagcugauuuaucauuggaaaaagcggcugagguauccugggaagaagaagcagaacacuccggcaccucacacaacauauuaguggagguccaagaugauggaacuaugaaaauaaaagaugaagagagggaugauacacucaccauacuccucaaagcaacucugcuggcagucucaggaguguacccaaugucaauaccggcaacucuuuuugugugguauuuuuggcagaaaaagaaacagagaucaggaguguuaugggacacacccagcccuccggaaguggaaagggcaguucuugaugauggcauuuauagaaucuugcaaagaggacuguugggcaggucccaaguaggagugggaguuuuccaagacggcguguuccauacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacauccggaucucccaucgugaacagagagggaaaaauaguaggucuuuauggaaauggaguggugacaacaaguggaaccuacgucagugccaucgcucaagcuaaagcaacacaagaagggccucuaccagagauugaggacgagguguuuaagaaaagaaacuuaacaauaauggaccugcacccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaauuacaacaugauuaucauggaugaagcacauuuuaccgauccagccagcauagcagccagaggguacaucucaacccgaguggguaugggugaagcagcugcgaucuucaugacagccacucccccaggaucgguggaggccuuuccacagagcaaugcaguuauccaagaugaggaaagagacauuccugagagaucauggaacucaggcuaugacuggaucacugauuuuccagguaaaacaguuugguuuguuccaagcaucaaaucaggaaaugacauugcuaacuguuuaagaaagaacggaaaacgggugauucaacugagcaggaaaaccuuugacacugaguaccagaaaacaaaaaacaaugacugggacuacguugucacaacagacauuuccgaaaugggagcaaauuuccgggccgacaggguaauagauccaaggcggugccugaaaccgguaauacuaaaggaaggcccagagcgcguuauucuagccggaccgaugccagugacuguggccagugccgcccagaggagaggaagaauuggaaggaaccaaaacaaagaaggugaucaguacauuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccaguuuggcuauccuacaaaguugccucagaagguuuccaauacuccgacagaagauggugcuuugauggggaaaggaauaaccagguguuggaggagaacauggacguggagaucuggacaaaggaaggagaaagaaagaaauugcgaccccgcuggcuggaugcuagaacauacucugacccacuggcccugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauuccgaacaaggaggaaaagccuacagacaugccauggaagaacuaccagacaccauagaaacauugaugcuccuagcuuugauagcugugcugacugguggagugacgcuguucuuccuaucaggaaaaggucuagggaaaacauccauuggccuacucugugugauggccucaagcgcacuguuauggauggccaguguggagccccauuggauagcggccuccaucauauuagaguucuuucugauggugcugcucauuccagagccagacagacagcgcacuccacaggacaaccaguuagcauauguggugauagguuuguuauucaugauacugacaguggcagcuaaugagaugggauuguuggaaaccacaaagaaagaccuggggauuggccauguagccgucgaaaaccaccaccaugccacaaugcuggacguagaccuacguccagcuucagccuggacccucuaugcaguagccacaacaguuaucacccccaugaugagacacacaauugaaaauacaacggcaaauauuucccugacagccaucgcaaaccaggcugcuauauugauggggcuugauaagggauggccaauaucgaagauggauauaggaguuccacuucucgccuuagggugcuauucccaggugaacccauugacacuaacagcggcgguguugauguuaguggcucauuaugccauaauuggaccaggacugcaagcaaaggccacuagagaagcucaaaaaaggacagcggccggaauaaugaaaaauccaaccguagacggaauugucacaauagacuuggauccugugguuuaugaugcaaaauuugaaaaacagcuaggccaaauaauguuacugauacuuuguacaucacagauucucuugaugcggaccacaugggccuugugugaauccaucacacuggcuacuggacccuugaccacucuuugggagggaucuccaggaaaauucuggaacaccacgauagcaguguccauggcaaacaucuucaggggaaguuaucuagcaggagcaggucuggccuucucauuaaugaaaucuuuaggaggagguaggagagguacgggagcucaaggggaaacauugggagaaaaauggaaaagacaguuaaaccaacugagcaagucagaauuuaacaccuacaaaaagagugggauuauggagguggacagauccgaagcuaaagagggacugaaaagaggagaaacaaccaaacaugcagugucgagaggaacagccaaacugaggugguuuguggagagaaaccucgugaaaccagaagggaaagucauagaccucgguuguggaagaggugguuggucauauuacugcgcugggcugaagaaagucacugaagugaagggauacacaaaaggaggaccuggacaugaggaacccaucccaauggcgaccuauggauggaacuugguaaagcuacacucugggaaagauguauucuucacaccaccugagaaaugugacacccuuuugugugacauuggcgaguccucuccaaauccaacuauagaagaaggaagaacauuacguguucuaaagaugguggaaccauggcuuagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaacauaaaaaaugaacacaagucaacauggcauuaugaugaagacaauccauacaaaacaugggccuaucauggaucauaugaggucaaaccaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaaagaggcacagcacaaaucauggaggugacagccaagugguuaugggguuuccuauccagaaacaaaaaacccagaaucugcacaagagaggaguucacaagaaaaguuaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggccacgucaauuuuuaaacugaccuaccaaaauaagguggugagggugcaaagaccagcaaaaagugggaccgugauggaugucauauccagacgugaccagagaggaaguggacaggucggaacuuauggcuuaaauacuuucaccaauauggagguccaauuaauaagacaaauggagucugaaggaauuuucucacccagcgaauuggaaacccccaaucuagcuaagaaaguucuugacuggcuggaaaaacauggcgcugaaaggcugaaaagaauggcaauuagcggagaugauugcguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaucagcugaucaugaaagauggaagagaaauaguggugccaugccgcaaccaagaugaacuugugggcagggcuagaguaucacaaggcgcuggauggagccugagagaaacugcuugccuaggcaagucauaugcacaaauguggcagcugauguacuuucacaggagagaccugagacuagcggcuaaugcuaucuguucagccgucccaguugauugggucccaaccagccgcaccaccuggucgauccaugcccaccaccaauggaugacaacagaagacauguuaucaguguggaauaggguuuggauagaggaaaacccauggauggaagacaaaacucauguauccaguugggaagaaguuccauaccuagggaaaagggaagaucaaugguguggauccuugauagguuugacagcaagggccaccugggccacuaauauacaaguagccauaaaccaagugagaaggcucaucgggaaugagaauuaucuagauuauaugacaucaaugaagagauucaagaaugagagugaucccgaaggggcacucugguaa

SEQ ID NO: 5304 - RNA, 9879 nt, Artificial Sequence
  derived and/or modified CDS sequence (wt) from DENV-1__KF184975__SS-prME
ucugugaccaugcuccuuaugcugaugccuacagccuuggcuuuccauuugacuacacgagggggagagccgcacaugauagucagcaagcaggaaaggggaaagucacuuuuguucaagaccucugcaggugucaacaugugcacccuuauugcgauggauuugggagaguuaugugaggacacaaugacuuacaaaugcccucgaaucacugaagcggaaccagaugacguugacuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcuaaagacaaaccaacacuggacauugaacucuugaagacggaagucacaaacccugccguccugcgcaaacugugcauugaagccaaaauaucaaacaccaccacugacucaagauguccaacacaaggagaagccacacugguggaagaacaagacgcgaacuuugugugucgacgaacguuuguggacagaggcuggggcaauggcugugggcucuucggaaaaggaagccuacugacgugugcuaaguuuaagugugugacaaaacuggaaggaaagauaguucaauaugaaaacuugaaauauucagugauagucaccguccacacugaggaccagcaucaggugggaaaugaaaccacagaacaugggacaauugcaacuauaacaccucaagcucccacgucggaaauacagcugaccgacuacggagcucuuacauuggauuguucaccuagaacaggauuagacuucaaugaaaugguguuguugacaaugaaagaaaaaucauggcuaguucacaaacaaugguuucuagacuuaccacugccuuggaccucgggagcuucaacaucucaggagacuuggaacagacaagauuuguugguuacauuuaagacagcucaugcaaagaagcaggaaguagucguacugggaucacaagaaggagcaaugcacacugcguugacuggggcgacagaaauccagacgucaggaacaacaacaauuuuugcaggacaucugaaaugcagacuaaaaauggauaaacuaacuuuaaaagggaugucauaugugaugugcacaggcucauuuaaguuagagaaggaaguggcugagacccagcauggaaccguuuuagugcagguuaaauacgaaggaacagaugcaccaugcaagauccccuucucgauccaagaugagaaaggagugauccagaaugggagauugauaacagccaaucccauagucacugacaaagaaaaaccagucaacauugagacagaaccaccuuuuggugagagcuacaucguggugggggcaggcgaaaaaacucugaaacuaagcugguucaaaaaaggaagcagcauaggaaaaauguucgaagcaaccgcccgaggagcacgaaggauggcuauucuaggagacaccgcaugggacuucgguuccauaggaggaguguucacaucugugggaaaacugguacaccagguuuucggaaccgcauaugggguuuuguucagcggugucucuuggaccaugaaaauaggaauagggauccugcugacauggcuaggauuaaauucaaggagcacgucacuuucaaugacuugcauugcaguuggcauggucacacuguaccuaggagucaugguucaggcggacucaggauguguaaucaauuggaagggcagagaacucaaauguggaaguggcauuuuugucacuaacgaaguccacacuuggacagagcaauacaaauuccaagcugacuccccaaaaagacugucagcagccauugggaaggcaugggaggagggcguguguggaauacgaucagccacacgucuggagaacgucauguggaagcaaauaucaaaugaauugaaccauauucuacuugaaaacgacaugaaauucacagugguugugggagauguuaauggaaucuuggcccaggggaagaaaaugguuaggccacaacccauggaacacaaauacucauggaaaaguuggggaaaagccaaaaucauaggagcagauauacagaauaccaccuucaucaucgacgguccagacacuccagaaugccccgaugaccaaagagcauggaacauuugggaaguugaggacuauggguuuggaaucuucacgacaaacauauggcugaaauugcgugauuccuacacccaaaugugugaccaccggcugaugucagcugccaucaaggacaguaaggcaguccaugcugacaugggguacuggauagaaagugaaaagaacgagaccuggaagcuagcgagagccucauucauagaagucaagacaugcaucuggccaaaaucccacacucuauggaguaauggaguuuuggaaagugaaaugauaaucccaaagauauauggaggaccaacaucucagcacaacuacagaccaggguauuucacacaaacagcaggaccauggcaccuaggcaaguuggaacuagauuuugauuugugcgaaggcaccacaguaguuguggaugaacauuguggaaaucgagguccaucucuuagaaccacaacagucacaggaaagauaauccaugaaugguguuguagauccugcacguuaccccccuuacguuuuaaaggggaagacggauguugguauggcauggaaaucagaccagucaaggagaaggaagagaaccuagucaggucaauggucucugcagggucaggagaaguggacaacuuuucauugggacuauuauguguaucaauaaugguugaagaagugaugagaucuagauggaguagaaagaugcugaugacuggaacauuggcuguuuuucuccuucuuauaaugggacaacugacauggaaugaucugauuagguuaugcaucaugguuggagcuaaugccucagacaggauggggaugggaacaacguaccuagccuugauggccaccuucaaaaugagaccaauguucgcuguugggcuauuauuucgcagauuaacauccagagaaguccuucuucucacaauuggauuaagccugguggcauccguggagcuaccaaacucucuagaggagcuaggagauggacuugcaaugggcaucaugauguuaaaauuacugaccgauuuucagucacaccagcuauggaccaccuuacugucccugacauuugucaaaacaacucuuucauuggauuaugcauggaagacaauggccaugguguugucaauaguaucucucuuuccuuuauguuuguccacgaccucucaaaaaacaacauggcuuccggugcuguuaggauccuuuggaugcaaaccauuaaccauguuccucauaacagaaaauaaaaucuggggaaggaagaguuggccccucaacgaaggaauuauggcuguuggaauagcuagcauucuauuaaguucacuucuaaaaaaugaugugccgcuagcuggcccacuaauagccggaggcaugcuaauagcauguuaugucauauccgggagcucagccgauuuaucucuggagaaagcggcugaggucuccugggaagaagaagcagaacacucuggcgccucacacaacaucuuaguggagguccaagacgauggaacuaugaaaauaaaagaugaagagagagaugacacacucaccauacuccuuaaagcaacucugcuggcaguuucagggguguacccaaugucaauaccagcaacccuuuuugugugguauuuuuggcagaaaaagaaacagagaucaggaguguuaugggacacacccagcccuccagaagcggaaaaagcaguucuugaugauggaauuuauagaaucuugcaaagaggacuguugggcaggucccagguaggagugggagucuuccaagauggcguguuccacacaauguggcacgucaccaggggagcuguccucauguaccaagggaagaggguggaaccaagcugggcuagugucaaaaaagacuugaucucauauggaggagguuggagguuccaaggacuauggaacacgggagaagaagugcaggugauagccguugaaccaggaaaaaaccccagaaauguacagacaacaccaggcaccuucaagaccccugaaggcgaagucggagccauagcccuagacuuuaaacccggcacaucuggaucucccaucguaaacagagagggaaaaauagugggucucuauggaaauggaguggugacaacaaguggaaccuacguuagugccauugcccaagccaaagcaucacaagaagggccucuaccagagauugaggacgagguguuuaggaaaagaaacuuaacaauaauggaccuacauccagggucaggaaaaacaagaagauaccuuccggccauaguccgugaggccauaaaaaggaaacugcguacgcuaaucuuagcucccacaagagucgucgccucugaaauggcagaggcgcuuaaaggaaugccaauaagauaucagacaacagcagugaagacugaacacacgggaagggagauuguugaccucaugugccacgccacuuucaccaugcgucucuuaucuccggugagaguucccaauuacaacaugauuauuauggacgaggcacauuucacugauccagccagcauagcagccagaggguauaucucaacccgagugggcaugggugaagcagcugcgauuuuuaugacggccacucccccaggaucgauggaggccuuuccacagagcaaugcaguuauccaagaugaggaaagagauauuccugagagaucauggaacucagguuaugauuggaucaccgacuucccagguaaaacagucugguuugucccaagcaucaaaucaggaaaugacauugccaacuguuuaagaaagaacgggaaacgggugauccaguugagcaggaaaaccuuugacacugaguaccagaaaacaaaaaacaacgacugggacuauguugucacaacagacauuuccgaaaugggagcaaauuuccgggcugacaggguaauagacccaaggcggugcuugaagccgguaauacuaaaagaugguccagagcgugucauucuagccggaccgaugccagugacuguggccagugcugcccagaggagaggaagaauuggaaggaaccaaaacaaggaaggugaucaauauguuuacaugggacagccuuuaaacaacgaugaggaccaugcucauuggacagaagcgaaaaugcuccuugacaauauaaacacaccagaagggauuauuccagcucucuuugagccggagagagaaaagagugcagcaauagacggggaguacagacugaggggagaagcaaggaaaacguucguggagcucaugagaagaggagaucuaccaguuuggcuaucuuacaagguugccucagagggcuuccaauacuccgauagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuagaaauagggagacuuccacaacauuugacgcuaaaggcccagaaugcuuuggacaacuuggucauguugcacaauuccgaacaaggaggaaaagccuauagacaugccauggaagaacuaccagacacuauagaaacauugaugcuucuagcuuugauagcugugcugacugguggagugacgcuauucuuccuaucaggaaaaggucuagggaaaacauccauuggcuuacucugugugauggccucaagcguacuguuauggauggccaguguggagccccauuggauagcggccuccaucauauuagaauucuuucugauggugcugcucauuccagagccagacagacagcgcacuccgcaggacaaccaacuagcguauguggugauaggcuuguuauucauaauauugacaguggcagccaaugagaugggauuauuggaaaccacaaagaaagaccuggggauuggccauguggcugccgaagaccaccaacaugcuacaaugcuggacguagaucuacguccagcuucagccuggacccucuaugcaguggccacaacaaucaucacuccuaugaugagacacacaauugaaaacacaacggcaaacauuucccugacagcuauugcaaaccaggcagccauauugaugggacuagacaagggauggccgauaucgaagauggauauagggguuccacuucucgcuuuaggaugcuauucucaggugaacccauuaacacugacagcagcgguguugaugcuaguggcucauuaugcuauaauuggaccuggauugcaagcaaaagccacuagagaagcucagaaaaggacagcggcuggaauaaugaaaaauccaaccguagacgggauugucgcaauagaucuggauccugugguuuacgauacaaaguuugaaaaacagcugggucaaauaauguuacugauacuuugcacaucacagauucuccugaugcggaccacaugggccuugugugaauccaucacacuagcuacuggacccuugaccacucuuugggagggaucuccaggaaaauucuggaacaccacgauagcagugucuauggcaaacaucuucagaggaaguuaucuagcaggagcaggccuggccuuuucauuaaugaaaucuuuaggaggagguaggagaggcacgggggcucaaggggaaacgcugggagaaaaauggaaaagacagcugaaccaacugaguaagucagaauucaacacuuacaagaggagcgggauuacugagguggacagaucugaagccaaagagggacugaagagaggagaaacaaccaaacaugcagugucgagaggagcagccaaacugaggugguucguggagagaaaccucgugaaaccagaggggaaagucauagaccuugguuguggaagagguggcuggucauauuacugcgcuggguugaagaaagucacagaagugaagggauacacaaaagggggaccuggacaugaggaacccaucccaauggcgaccuauggauggaaccuaguuaagcuacacuccggaaaagacguauucuucauaccaccugagaaaugugauacccuuuugugugauauuggugaguccucuccgaauccaaccauugaagaaggaagaacguuacguguucuaaagaugguggaaccauggcucagaggaaaucaauuuugcauaaaaauucuaaauccuuacaugccaagugugguagaaacccuggagcaaaugcaaagaaaacauggagggauguuagugcggaacccacuaucaagaaauuccacccaugaaauguacuggguuucauguggaacaggaaacauugugucggcagugaacaugacauccagaauguugcugaaucgauucacaauggcucacaggaagccaacauaugaaagagacguggauuuaggcgcuggaacaagacauguggcaguagaaccagagguggccaaccuagauaucauuggccagaggauagagaauauaaaaaaugaacacaagucaacauggcauuaugaugaggacaauccauacaaaacaugggccuaucauggaucauaugaggucaagccaucaggaucagccucauccauggucaaugguguagugagacugcucaccaaaccaugggaugucauccccauggucacacaaauagcuaugacugauaccacacccuuuggacaacagaggguguuuaaagagaaaguugauacgcgcacaccaagagcaaaacgaggcacagcacaaauuauggaggugacagccaagugguuaugggguuuccuuucuagaaacaaaaaacccagaaucugcacaagagaggaguucacaaggaaagucaggucaaaugcagcaauuggagcaguguucguugaugaaaaucaauggaacucagcaaaagaagcaguggaagacgaaagguuuugggaucuugugcacagagagagggagcuucauaagcagggaaaaugugccacgugugucuauaauaugauggggaagagagagaaaaaauuaggagaguuuggaaaggcaaaaggaagucgugcaauaugguacaugugguugggagcacgcuuucuagaguucgaagcucuugguuucaugaaugaagaucacugguucaguagagagaauucacucaguggaguggaaggagaaggacuacacaaacuuggauacauacucagagacauaucaaagauuccagggggaaacauguaugcagaugacacagcuggaugggacacaagaauaacagaggaugaucuucagaaugaagcuaaaaucacugacaucauggagcccgaacaugcucuauuggcuacaucaaucuuuaagcugaccuaccaaaacaaggugguuagggugcaaagaccagcaaaaaguggaaccgugauggauguuauauccagacgugaccagagaggaaguggacaggucggaacuuauggcuuaaauacuuucaccaacauggagguccaacuaauaagacaaauggagucugagggaaucuuucuacccagcgaauuggaaacccccaaccuagcugagagagcucucgacugguuggaaaaacauggcgucgaaaggcugaaaagaauggcaaucagcggagaugacuguguggugaaaccaacugaugacagguucgcaacagccuuaacagcucugaaugacaugggaaaaguaagaaaagacauaccgcaaugggaaccuucaaaggguuggaaugacuggcagcaagugccuuucuguucacaccauuuccaccagcugaucaugaaggaugggagggagauaguggugccaugccgcaaccaagaugaacuugugggcagggccagaguaucgcaaggcgccggauggagcuugagagaaacugcuugccuaggcaagucauaugcacaaauguggcagcugauguauuuccacaggagagaccuaagacuggcggccaaugcuaucuguucagccguuccaguugauugggucccaaccagccguaccaccuggucgauccaugcccaccaucaauggaugacaacagaggacauguuaucaguguggaauaggguuuggauagaggaaaacccauggauggaggacaaaacucauguguccaguugggaggacguuccauacuuagggaaaagagaagaucagugguguggauccuugauaggcuugacagcuagggcuaccugggccaccaacauacaaguagccauaaaccaagugagaaggcuuauugggaaugagaauuaucuagauuacaugacaucaaugaagagauucaagaaugaaagugaucccgaaggggcacucugguaa

SEQ ID NO: 5305 - RNA, 9879 nt, Artificial Sequence
  derived and/or modified CDS sequence (wt) from DENV-1__KT831765__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcagguguuaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacaggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauagguagcagggacuucguggaaggacugucaggagcaacuuggguagacguggugcuggaacauggaaguugcgucacuaccauggcaaaagacaaaccaacauuggacauugaacucuugaagacggaagucacaaacccugccguccugcgcaaacugugcauugaagccaaaauaucaaacaccaccaccgacucaagauguccaacacaaggagaagccacacugguggaagaacaagacgcgaacuuugugugucgacgaacguuuguggacagaggcuggggcaauggcugugggcuuuucggaaaaggaagccuuauaacgugugcuaaguucaagugugugacaaaacuggaaggaaaaauaguucaauaugaaaacuugaaauauucaguaauaguuaccguucacacuggagaccagcaccaggugggaaaugaaagcacagaacaugggacaacugcaacuauaacaccucaagcuccuacgacagaaauacagcugaccgacuacggagcucuuacauuggauuguucaccuagaacaggacuagacuucaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcgaagaagcaggaaguagucguacugggaucacaagaaggagcaaugcacacugcguugaccggagcgacggaaauccaaacgucuggaacgacaacaauuuuugcaggacacuugaaauguagacuaaagauggauaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauagucacugacaaagaaaaaccagucaacauugaggcagaaccgccuuuuggugagaguuacauugugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcuaacaugguuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuugcuugaaaaugacaugaaauucacagugguuguaggagauguugcugggaucuuggcucaaggaaaaaagaugauuaggccacaacccauggaacacaaauacucguggaaaagcuggggaaaggcuaaaaucauaggggcagaugugcagaacaccaccuuuaucaucgacggcccaaacaccccagaaugcccugaugaucaaagagcauggaacauuugggaaguugaggauuauggauucggaauuuucacgacaaacauauggcugaaauugcgugacuccuacacccaagugugugaccaccggcuaaugucagcugcuaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaaccauagaccaggauauuucacacaaaccgcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuacagaggagaagauggguguugguacggaauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuauguaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacgauggccaugguacugucaauuguaucucucuuccccuuaugccuguccacgaccucccaaaaaacaacauggcuuccggugcuguugggaucucuuggaugcaaaccacuaaccauguuucuuauagcagaaaauaaaaucuggggaaggaaaaguuggccccucaaugaaggaaucauggcuguuggaauaguuagcauccuacuaaguucacuccucaaaaaugaugugccgcuagcugggccacuaauagcuggagguaugcuaauagcguguuaugucauaucuggaagcucggccgaucuaucacuagagaaagcggcugaggucuccugggaagaagaagcagaacacucuggcgccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaccaagggaaaagacuggaaccgagcugggcuagugucaaaaaagaccugaucucauauggaggagguuggaggcuucagggauccuggaacacgggagaagaagugcaggugauugcuguugaaccagggaaaaaccccaaaaauguacaaacagcgccaggcaccuuuaagacuccugaaggcgaaguuggagccauugcccuagauuuuaaacccggcacaucuggaucucccaucgugaacagagaagggaaaauaguaggucuguauggaaauggaguagugacaacaaguggaaccuaugucagugccauagcucaagccaaagcaucacaagaagggccucuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccagagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcaggaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaaggaauuaucccagcccucuucgagccggagagagaaaagagugcagcaauagacggggaauacagacugcggggugaagcaaggaaaacguuuguggagcucaugagaagaggagaucuaccugucuggcuaucuuacaaaguugccucagaaggcuuccaguacucugauagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguucaaagaguuugcagcaggaagaagaagugucucaggugaucuaauauuggaaauagggaaacuuccacaacacuugacgcaaagggcccagaaugccuuggacaaccugguuauguugcacaacuccgaacaaggaggaagagccuauagacaugcaauggaagaacugccagauaccauagaaacguugaugcuccuagcuuugauagcuguguuaacugguggagugacgcuguucuuccuaucaggaaagggcuuagggaaaacaucuaucggccuacucugcgugauggcaucaagcgugcugcuauggauggccaguguagagccccauuggauagcggccuccaucauacuggaguucuuccugauggugcugcuuauuccagagccagacagacaacgcacuccgcaggacaaccagcuggcauauguggugauagguauguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucacugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgcuauuauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaauaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauacacaaaaggaggaccuggacaugaagaaccaaucccaauggcgaccuauggauggaaccuaguaaagcugcacuccgggaaagacguauucuuuguaccaccugagaaaugugacacccuuuugugugauauuggugaguccucuccaaacccaacuauagaggaaggaagaacgcuacgcguccuaaagaugguggaaccauggcuuagaggaaaccaauuuugcauaaaaauucugaaucccuacaugccuagugugguggaaacucuggagcaaaugcaaagaaaacauggaggaaugcuggugcgaaauccacucucaagaaauucuacucaugaaauguauuggguuucauguggaacaggaaacauugugucagcaauaaacaugacauccagaauguugcuaaaucgauucacaauggcucacaggaaaccaacauaugaaagagacguggaccuaggcgccggaacaagacaugugacaguggaaccagagguagccaaccuagauaucauuggccagaggauagagaacauaaaaugugaacacaagucaacauggcauuaugaugaggacaauccauauaaaacaugggccuaucauggaucauaugaggucaagccaucaggaucagcuucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaagccaagaauuuguacaagagaggaguucacaagaaaaguuaggucaaacgcagccauuggagcaguguucguugacgaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaauuuggaaaggcaaaaggaagucgugcaauaugguacaugugguugggagcacgcuuucuagaauucgaagcucuugguuucaugaacgaagaucacugguucagcagagagaauucacucagcggaguggaaggagaaggacuccacaaacuuggauauauacucagagacauaucaaagauuucagggggaaacauguaugcagaugacacagccggaugggauacaaggauaacagaggaugaccuucagaaugaggccaaaauuacugagaucauggaacccgaacaugcccaacuggcuaaggcaaucuucaagcuaaccuaccaaaauaaagugguaaggguacagagaccagcaaaaaauggaaccgugauggaugucauauccagacgugaccagagaggaaguggccaagucggaacuuauggcuuaaacacuuucaccaacauggaagcccagcugauaagacaaauggagucugagggaaucuuuucacccagugaauuagagaccccaaauuuagccgagagaguucucgacuggcuggaaaaguauggcgucgaaaggcuaaaaagaauggcaaucaguggagaugacugcguagugaaaccaauugaugauagguuugcaacagcccuaacagcucugaaugauaugggaaaaguaagaaaagauauaccacaaugggaacccucaaaaggauggaaugauuggcaacaaguaccuuuuuguucacaccacuuccaccagcugauuaugaaggaugggagggaaauaguggugccaugccgcaaccaagaugaacuuguggguagggcuagagugucacaaggggcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccgcaccaccuggucgauccacgcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5306 - RNA, 9879 nt, Artificial Sequence
  derived and/or modified CDS sequence (wt) from DENV-1__KP188567__SS-prME
uccgugaccaugcuccucaugcugcuacccacagcccuggccuuccauuugacuacacgagggggagagccacacaugauagucagcaagcaggaaagaggaaagucacucuuguuuaagaccucuguaggugucaacaugugcacucucauugcgauggauuugggagaguuaugugaggacacaaugaccuacaaaugcccccggaucacugaggcggaaccagaugauguugacugcuggugcaaugccacagacacaugggugaccuaugggacguguucucaaaccggcgaacaccgacgagacaaacguuccgucgcacuggccccacacgugggacuuggucuagaaacaagaacugaaacguggaugucaucugaaggcgccuggaaacaaauacaaaaaguggagacuugggcuuugcgacacccaggauucacggugauagcccuuuucuuggcacaugccauaggaacauccaucacccagaaagggaucauuuucaucuugcugaugcugguaacaccaucaauggccaugcgaugcgugggaauaggcaauagagacuucguugaaggacugucaggagcaacguggguggacgugguacuggagcauggaagcugcgucaccaccauggcaaaaaacaaaccaacauuggacauugaacucuugaaaacggaggucacgaacccugccauccugcgcaaacugugcauugaagcuaaaauaucaaacaccaccaccgauucaagauguccaacacaaggagaagccacacugguggaagaacaagacgcgaacuuugugugucgacggacguucguggacagaggcugggguaauggcugcggacuauuuggaaaaggaagucuacugacgugugcuaaguucaagugugugacaaaacucgaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagacuuaccacugccuuggacuucgggagcuucaacaucccaagagacuuggaacagacaagauuugcuggucacauucaagacagcucaugcaaagaaacaggaaguagucgugcugggaucacaggaaggagcaaugcacacugcgcugacuggggcgacagaaauccagacgucaggaacgacaacaauuuuugcgggacaccugaaauguagacuaaaaauggacaaacugacuuuaaaagggaugucauaugugaugugcacaggcucauuuaagcuagagaaggaaguggcugagacccagcauggaacuguuuuagugcagguuaaauacgaaggaacagacgcaccaugcaagaucccuuuucugacccaagaugaaaaaggagugacccagaaugggagauugauaacagcuaauccuauaguuacugauaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggccauccugggagacacugcaugggacuucggcucuauaggaggauuguucacgucugugggaaaauugauacaucagguuuuuggaacugcauaugggguucuguucagcgguguuucuuggaccaugaaaauaggaauagggauucugcugacaugguugggauuaaauucaaggagcacgucacuuucaaugacgugcauugcaguuggcauggucacacuguaccuaggagucaugguucaagcggacucgggaugugugaucaacuggaagggcagagaacucaaauguggaaguggcaucuuugucacuaaugaaguccacacuuggacagagcaauauaaauuccaggcugacuccccaaaaagacugucagcagccauugggaaggcaugggaggaaggcguguguggaauucgaucagccacgcgucuugagaacaucauguggaagcaaauaucaaaugaauugaacuacauccuacuugaaaaugacaugaaauucacagugguugugggagacguuaauggaauuuuggcccaagggaaaaaaaugauuaaaccacaacccauggaacacaaauacucauggaaaaguuggggaaaagccaagaucauaggagcagacauacagaacaccaccuuuaucauugacggcccagauacuccagaaugccccgaugaccaaagagcauggaacauuugggaaguugaggacuacggguucggaauuuucacgacaaacauauggcugaaauugcgugacucccacacccaaaugugugaccaucggcuaaugucagcugccaucaaggacagcaaagcaguccaugcugauaugggguacuggauagaaagugaaaagaacgagaccuggaagcuagcgagagccuccuuuauagaagucaagacaugcaucuggccgaaaucccacacucuauggaguaauggaguuuuggaaagugaaaugguaaucccaaagauauauggaggaccaauaucucagcacaacuacagaccaggguauuucacacaaacagcagggccauggcaccuaggcaaguuggaauuggauuuugacuugugugaagguaccacaguuguuguagaugaacauuguggauaucgaggcccaucccucagaacuacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauuaggaauacuaugcguaucaauacugauugaagaagugaugagaucuagauggaguagaaagaugcugaugacuggaacacuggcuguuuuccuccuucucauaaugggacaacugacauggaaugaucugaucagguuaugcaucaugguuggagccaaugcuuuagacaggauggggauggggacaacguaccuagccuugauggccacuuucaaaaugagaccaauguucgcuguugggcuauuguuucgcagacuaacauccagagaaguucuucuucucacgguuggauuaagccugguggcauccguggagcuaccaagcucuuuagaggagcuaggggauggacuugcaaugggcaucaugauguuaaaauuauugacugacuuccagccacaccaguuauggaccacccuauugucucuaacauuuaucagaacaucucuuucauuggauuaugcauggaagacaauggcuauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccaucaaugaaggaauuauggcuguuggaauagucagcauucuacuaaguucacuccucaaaaaugaugugccgcuagccggcccacuaauagcuggaggcaugcuaauagcauguuaugucauaucuggaagcucagcugauuuaucauuggaaaaagcggcugagguauccugggaagaagaagcagaacacuccggcaccucacacaacauauuaguggagguccaagaugauggaacuaugaaaauaaaagaugaagagagggaugauacacucaccauacuccucaaagcaacucugcuugcagucucaggaguguacccaaugucaauaccggcaacucuuuuugugugguauuuuuggcagaaaaagaaacagagaucaggagugcuaugggacacacccagcccuccggaaguggaaagggcaguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccaucgcucaagcuaaagcaacacaagaagggacucuaccagagauugaggacgagguguuuaagaaaagaaacuuaacaauaauggaccugcauccaggaucagggaaaacaagaagauaucuuccagccauaguccgugaggccauaaaaaggaagcugcgcacgcuaaucuuggcucccacaagaguugucgccucugaaauggcagaggcgcucaagggaaugccgauaagauaccagacaacagcagugaagagugaacauacaggaagggagauaguugaccucaugugccaugccacuuuuaccaugcgucucuuaucuccagugagaguucccaauuacaacaugauuaucauggaugaagcacacuuuacugauccagccagcauagcagccagaggguacaucucaacccgaguggguaugggugaagcagcugcgauuuucaugacagccacucccccaggaucgguggaggccuuuccacagagcaaugcaguuauccaagaugaggaaagagacauuccugagagaucauggaacucaggcuacgacuggaucacugauuuuccagguaaaacaguuugguuuguuccaagcaucaaaucaggaaaugacauugcuaacuguuuaagaaagaacggaaaacgggugauucaacugagcaggaaaaccuuugacacugaguaccagaaaacaaaaaacaaugacugggacuacguugucacaacagacauuuccgaaaugggagcaaauuuccgggccgacaggguaauagauccaaggcggugcuugaaaccgguaauacuaaaggaagguccagagcgcguuauucuagccggaccgaugccagugacuguggccagugccgcccagaggagaggaagaauuggaaggaaccaaaacaaagaaggugaucaguacauuuacaugggacagccuuugaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccaguuuggcuauccuacaaaguugccucagaagguuuccaauacuccgacagaagauggugcuuugauggggaaaggaacaaccagguguuggaggagaacauggacguggagaucuggacaaaggaaggagaaagaaagaaauugcgaccccgcuggcuggaugcuagaacauacucugacccacuggcccugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauuccgaacaaggaggaaaagccuacagacaugcuauggaagaacuaccagacaccauagaaacauugaugcuccuagcuuugauagcugugcugacugguggagugacguuguucuuccuaucaggaaaaggucuagggaaaacauccauuggccuacucugugugauggccucaagcgcacuguuauggauggccaguguggagccccauuggauagcggcuuccaucauauuagaguucuuucugauggugcugcucauuccagagccagacagacagcgcacuccacaggacaaccaguuagcauauguggugauagguuuguuauucaugauacugacaguggcagcuaaugagaugggauuguuggaaaccacaaagaaagaccuggggauuggccauguagccgucgaaaaccaccaccaugccacaaugcuggacguagaccuacguccagcuucagccuggacccucuaugcaguagccacaacaguuaucacccccaugaugagacacacaauugaaaauacaacggcaaauauuucccugacagccaucgcaaaccaggcugcuauauugauggggcuugauaagggauggccaauaucgaagauggauauaggaguuccacuucucgccuuagggugcuauucccaggugaacccauugacacuaacagcggcgguguugauguuaguggcucauuaugccauaauuggaccaggacugcaagcaaaggccacuagagaagcucaaaaaaggacagcggccggaauaaugaaaaauccaaccguagacgggauugucacaauagacuuggauccugugguuuaugaugcaaaauuugaaaaacagcuaggccaaauaauguuacugauacuuuguacaucacagauucucuugaugcggaccacaugggccuugugugaauccaucacacuggccacuggacccuugacuacucuuugggagggaucuccaggaaaauucuggaacaccacgauagcaguguccauggcaaacaucuucaggggaaguuaucuagcaggagcaggucuggccuucucguugaugaaaucuuuaggaggagguaggagagguacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucauagaccucgguugugggagaggugguuggucauauuacugcgcuggacugaagaaagucacugaagugaagggauacacaaaaggaggaccuggacaugaggaacccaucccaauggcgaccuauggauggaacuugguaaagcuacacucugggaaagauguauucuucacaccaccugagaaaugugacacccuuuugugugacauuggugaguccucuccaaauccaacuauagaagaaggaagaacauuacguguucuaaagaugguggaaccauggcuuagaggaaaccaauucugcauaaaaauucuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaacauaaaaaaugaacauaagucaacauggcauuaugaugaagacaauccuuacaaaacaugggccuaucauggaucauaugaggucaaaccaucaggaucagccucauccauggugaauggcguggugagauugcucacuaaaccaugggaugucauccccauggucacacaaauagcuaugacugauaccacacccuuuggacaacagaggguguuuaaagagaaaguugacacgcgcacaccaagagcaaaaagaggcacagcacaaaucauggaggugacagccaagugguuaugggguuuccuauccagaaacaaaaaacccagaaucugcacaagagaggaguucacaagaaaagucaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaacgaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggccacgucaauuuuuaaacugaccuaccaaaauaagguggugagggugcaaagaccagcaaaaagugggaccgugauggaugucauauccagacgugaccagagaggaaguggacaggucggaacuuauggcuuaaauacuuucaccaauauggagguccaauuaauaagacaaauggagucugaaggaauuuucucacccagcgaauuggaaacccccaaucuagcuaagaaaguucuugacuggcuggaaaaacauggcgcugaaaggcugaaaagaauggcaauuagcggagaugauuguguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaucagcugaucaugaaagauggaagagaaauaguggugccaugccgcaaccaagaugaacuugugggcagggcuagaguaucacaaggcgcuggauggagccugagagaaacugcuugccuaggcaagucauaugcacaaauguggcagcugauguacuuucacaggagagaccugaggcuagcggcuaaugcuaucuguucagccgucccagcugauugggucccaaccagccgcaccaccuggucgauccaugcccaccaccaauggaugacaacagaagacauguuaucaguguggaauaggguuuggauagaggaaaacccauggauggaagacaaaacucauguauccaguugggaagaaguuccauaccuaggaaaaagggaagaucaaugguguggauccuugauagguuugacagcaagggccaccugggccacuaauauacaaguagcuauaaaccaagugagaaggcucaucgggaaugagaauuaucuagacuauaugacaucaaugaagagauucaagaaugagagugaucccgaaggggcacucugguaa

SEQ ID NO: 5307 - RNA, 9879 nt, Artificial Sequence
  derived and/or modified CDS sequence (wt) from DENV-1__KP188568__SS-prME
uccgugaccaugcuccucaugcugcugcccacagcccuggccuuccauuugacuacacgagggggagagccacauaugauagucagcaagcaggaaagaggaaagucacucuuguuuaagaccucuguaggugucaacaugugcacucucaucgcgauggauuugggagaguuaugugaggacacaaugaccuacaaaugcccccggaucacugaggcggaaccagaugauguugacugcuggugcaaugccacagacacaugggugaccuaugggacguguucucaaaccggcgaacaccgacgagacaaacguuccgucgcacuggccccacacgugggacuuggucuagaaacaagaacugaaacguggaugucaucugaaggcgcuuggaaacaaauacaaaaaguggagacuugggcuuugcgacacccaggauucacggugauagcccuuuucuuggcgcaugccauaggaacauccaucacccagaaagggaucauuuucauuuugcugaugcugguaacaccaucaauggccaugcgaugcguaggaauaggcaauagagacuucguugaaggacugucaggagcaacguggguggacgugguacuggagcauggaagcugcgucaccaccauggcaaaaaacaaaccaacauuggacauugaacucuugaaaacggaggucacgaacccugccguccugcgcaaacugugcauugaagcuaaaauaucaaacaccaccaccgauucaagauguccaacacaaggagaagccacacugguggaagaacaagacgcgaacuuugugugucgacggacguucguggacagagguugggguaauggcugcggacuauuuggaaaaggaagucuacugacgugugcuaaguucaagugugugacaaaacuagaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuucaaugagauggugcuacugacaaugaaagaaaaaucauggcuuguccacaaacaaugguuucuagacuuaccacugcccuggacuucgggagcuucaacaucccaagagacuuggaacagacaagauuugcuggucacauucaagacagcucaugcaaagaaacaggaaguagucgugcugggaucacaggaaggagcaaugcacacugcgcugacuggggcgacagaaauccagacgucaggaacgacaacaauuuuugcgggacaccugaaauguaggcuaaaaauggauaaacugacuuuaaaagggaugucauaugugaugugcacaggcucauuuaagcuagagaaggaaguggcugagacccagcauggaacuguuuuagugcaggucaaauacgaaggaacagaugcaccaugcaagaucccuuuuuugacccaagaugagaaaggagugacccagaaugggagauugauaacagcuaauccuauaguuacugauaaagaaaaaccagucaacauugagacagaaccaccuuuuggugagagcuacaucgugguaggggcaggugaaaaagcuuugaaacuaagcugguucaagaaaggaaguagcauagggaaaauguucgaagcaaccgcccgaggagcacgaaggauggccauccugggagacaccgcaugggacuucggcucuauaggaggauuguucacguccgugggaaaauugauacaccagguuuuuggaacugcauaugggguucuguucagcgguguuucuuggaccaugaaaauaggaauagggauucugcugacaugguugggauuaaauucaaggagcacgucacuuucaaugacgugcauugcaguuggcauggucacacuguaccuaggagucaugguucaagcggacucgggaugugugaucaacuggaagggcagagaacucaaauguggaaguggcaucuuugucacuaaugaaguccacacuuggacagagcaauauaaauuccaggcugacuccccaaaaagacugucagcagccauugggaaggcaugggaggaaggcguguguggaauucgaucagccacgcgucuugagaacaucauguggaagcaaauaucaaaugaauugaaccacauccuacuugaaaaugacaugaaauucacagugguuguaggagacguuaauggaauuuuggcccaaggaaaaaaaaugaucagaccacaacccauggaacacaaauacucauggaaaaguuggggaaaagccaagaucauaggagcagacauacagaacaccaccuuuaucauugacggcccagauacuccagaaugccccgaugaccaaagagcauggaacauuugggaaguugaggacuacggguucggaauuuucacgacaaacauauggcugaaauugcgugacucccacacccaaaugugugaccaucggcuaaugucagcugccaucaaggacagcaaagcaguccaugcugauaugggguacuggauagaaagugaaaagaacgagaccuggaagcuagcgagagccuccuuuauagaagucaagacaugcaucuggccgaaaucccacacucuauggaguaauggaguuuuggaaagugaaaugguaaucccaaagauauauggaggaccaauaucucagcacaacuacagaccaggguauuucacacaaacagcagggccauggcaccuaggcaaguuggaauuggauuuugacuugugugaagguaccacaguuguuguagaugaacauuguggauaucgaggcccaucucucagaacuacaacaguuacaggaaagauaauccaugaaugguguugcagauccugcacguuaccccccuuacgcuucagaggagaagacggauguugguauggcauggaaauuagaccaguuaaggagaaggaggagaaccuaguuaggucaauggucucugcagggucaggagaaauggacaguuuuucauuaggaauacuaugcguaucaauacugauugaagaaguaaugagauccagauggaguagaaagaugcugaugacuggaacacuggcuguuuucuuccuucucauaaugggacaacugacauggaaugaucugaucagguuaugcaucaugguuggagccaaugcuucagacaggauggggauggggacaacguaccuagccuugauggccacuuucaaaaugagaccaauguucgcuguugggcuauuauuucgcagacuaacguccagagaaguucuucuucucacgguuggauuaagccugguggcauccguggagcuaccaaauucuuuagaggaacuaggggauggacuugcaaugggcaucaugauguuaaaauuauugacugacuuccagccacaccaguuauggaccacccuauugucucuaacauuuaucagaacaucucuuucauuggauuaugcauggaagacaauggcuauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccauaaaugaaggaauuauggcuguuggaauagucagcauucuacuaaguucacuccucaaaaaugaugugccgcuagccggcccacuaauagcuggaggcaugcuaauagcauguuaugucauaucuggaagcucagcugauuuaucauuggaaaaagcggcugagguauccugggaagaagaagcagaacacuccggcaccucacacaacauauuaguggagguccaagaugauggaacuaugaaaauaaaagaugaagaaagggaugauacacucaccauacuccucaaagcaacucugcuggcagucucaggaguguacccaaugucaauaccagcaacucuuuuugugugguauuuuuggcagaaaaagaaacagagaucaggaguguuaugggacacacccagcccuccggaaguggaaagggcaguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacauccggaucucccaucgugaacagagagggaaaaauaguaggucuuuauggaaauggaguggugacaacaaguggaaccuacgucagugccaucgcucaagcuaaagcaacacaagaagggccucuaccagagauugaggaugagguguuuaagaaaagaaacuuaacaauaauggaccugcauccaggaucagggaaaacaagaagauaucuuccauccauaguccgugaggccauaaaaaggaagcugcgcacgcuaauuuuggcucccacaagaguugucgccucugaaauggcagaggcgcucaagggaaugccaauaagauaucagacaacagcagugaagagugaacauacaggaagggagauaguugaccucaugugccaugccacguuuaccaugcgucuuuuaucuccagugagaguucccaauuacaacaugauuaucauggaugaagcacacuuuaccgauccagccagcauagcagccagaggguacaucucaacccgaguggguaugggugaagcagcugcgaucuucaugacagccacucccccaggaucgguggaggccuuuccacagagcaaugcagcuauccaagaugaggaaagagacauuccugagagaucauggaacacaggcuacgacuggaucacugauuuuccagguaaaacaguuugguuuguuccaagcaucaaaucaggaaaugacauugcuaacuguuuaagaaagaacggaaaacgggugauucaacugagcaggaaaaccuuugacacugaguaccagaaaacaaaaaacaaugacugggacuacguugucacaacagacauuuccgaaaugggagcaaauuuccgggccgacaggguaauagauccaaggcggugcuugaaaccgguaauacuaaaggaagguccagagcgcguuauccuagccggaccgaugccagugacuguggccagugccgcccagaggagaggaagaauuggaaggaaccaaaauaaagaaggugaucaguacauuuacaugggacagccuuuaaacaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccaguuuggcuauccuacaaaguugccucagaagguuuccaauacuccgacagaagauggugcuuugauggggaaaggaauaaccagguguuggaggagaacauggacguggagaucuggacaaaagaaggagaaagaaagaaauugcgaccccgcugguuggaugcuagaacauacucugacccacuggcccugcgcgaguuuaaagaguuugcagcaggaagaagaagugucucaggugaccuaauauuggaaauaggaaaacuuccacaacacuugacgcuaagagcccagaaugcucuggacaacuuggucauguugcacaauuccgaacaaggaggaaaagccuacagacaugcuauggaagaacuaccagacaccauagaaacauugaugcuccuagccuugauagcugugcugacugguggagugacgcuguucuuccuaucaggaaaaggucuagggaaaacauccauuggccuacucugugugauggccucaagcgcacuguuauggguggccaguguggagccccauuggauagcggccuccaucauauuagaguucuuucugauggugcugcucauuccagagccagacagacagcgcacuccacaggacaaccaguuagcauauguggugauagguuuguuauucaugauacugacaguggcagcuaaugagaugggauuguuggaaaccacaaagaaagaccuggggauuggccauguagccgucgaaaaccaccaccaugccacaaugcuggacguagaccuacguccagcuucagccuggacccucuaugcaguagccacaacaguuaucacccccaugaugagacacacaauugaaaauacaacggcaaauauuucccugacagccaucgcaaaccaggcugcuauauugauggggcuugacaagggauggccaauaucgaagauggauauaggaguuccacuucucgccuuagggugcuauucccaggugaacccauugacacuaacagcggcgguguugauguugguggcucauuaugccauaauugggccaggacugcaagcaaaggccacuagagaagcucaaaaaaggacagcggccggaauaaugaaaaauccaaccguagacgggauugucacaauagacuuggauccugugguuuaugaugcaaaauuugaaaaacagcuaggucaaauaauguuacugauacuuuguacaucacagauucucuugaugcggaccacaugggccuugugugaauccaucacacuggcuacuggacccuugaccacucuuugggagggaucuccaggaaaauucuggaacaccacgauagcaguguccauggcaaacaucuucaggggaaguuaucuagcaggagcaggucuggccuucucggugaugaaaucuuuaggaggagguaggagagguacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucauagaccucgguugugggagaggugguuggucauauuacugcgcugggcugaagaaagucacugaagugaagggauacacaaaaggaggaccuggacaugaggaacccaucccaauggcgaccuauggauggaacuugguaaagcuacacuccgggaaagauguauucuucacaccaccugagaaaugugacacccuuuugugugacauuggugaguccucuccaaauccaacuauagaagaaggaagaacauuacguguucuaaagaugguggaaccauggcuuagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaauauugugucagcagugaacaugacauccagaauguuacugaaccgauucacaauggcucacaggaagccaacauaugaaagagacguggacuuaggcgcugggacaagacauguggcaguggaaccagagguagccaaccuagauauuauuggccagaggauagagaacauaaaaaaugaacauaagucaacauggcauuaugaugaagacaauccauacaaaacaugggccuaucauggaucauaugaggucaaaccaucaggaucagccucauccauggugaauggcguggugagauuacucaccaaaccaugggauguuauucccauggucacacaaauagccaugacugauaccacacccuucggacaacagaggguguuuaaagagaaaguugacacgcgcacaccaagagcaaaaagaggcacagcacaaaucauggaggugacagccaagugguuaugggguuuccuauccagaaacaaaaaacccagaaucugcacaagagaggaguucacaagaaaaguuaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggccacgucaauuuuuaaacugaccuaccaaaauaagguggugagggugcaaagaccagcaaaaagugggaccgugauggaugucauauccagacgugaccagagaggaaguggacaggucggaacuuauggcuuaaacacuuucaccaauauggagguccaguuaauaagacaaauggagucugaaggaauuuucucacccagcgaauuggaaacccccaaucuagcuaagaaaguucuugacuggcuggaaaaacauggcgcugaaaggcugaaaagaauggcaauuagcggagaugauuguguggugaaaccaauugaugauagguucgcaacagccuuaacagcuuugaaugauaugggaaaaguaagaaaagacauaccgcagugggaaccuucaaaaggauggaaugacuggcagcaagucccuuucuguucacaccacuuccaucagcugaucaugaaagauggaagagaaauaguggugccaugccgcaaccaagaugaacuugugggcagggcuagagugucacaaggcgcuggauggagccugagagaaacugcuugccuaggcaagucauaugcacaaauguggcagcugauguacuuucacaggagagaccugagacuagcggcuaaugcuaucuguucagccgucccaguugauugggucccaaccagccgcaccaccuggucgauccaugcccaccaccaauggaugacaacagaagacauguuaucaguguggaauaggguuuggauagaggaaaacccauggauggaagacaaaacucauguauccaguugggaagaaguuccauaccuagggaaaagggaagaucaaugguguggauccuugauagguuugacagcaagggccaccugggccacuaauauacaaguagccauaaaccaagugagaaggcucaucgggaaugagaauuaucuagauuauaugacaucaaugaagagauucaagaaugagagugaucccgaaggggcacucugguaa

SEQ ID NO: 5308 - RNA, 9879 nt, Artificial Sequence
  derived and/or modified CDS sequence (wt) from DENV-1__KF971870__SS-prME
ucugugaccaugcuucuuaugcugaugcccacagccuuggcguuccauuugacuacacgagggggagagccgcacaugaugguuagcaagcaggaaagaggaaagucacuucuguuuaagaccucagcaggugucaacaugugcacccuuauagcgauggauuugggagaguuaugugaggacacaaugacuuacaaaugcccucgaaucacugaggcggaaccagaugauguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacauccaggauuuacggugauagcccucuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaauuuugugugucgacgaacguuuguggauagaggcuggggcaauggcugugggcucuucggaaaaggaagccuuauaacgugugcuaaguucaagugugugacaaaauuggaaggaaaaauaguucaauaugaaaacuugaaauauucaguaauugucaccguccacacuggagaccagcaccaagugggaaaugaaagcacagaacaugggacaacugcaacuauaacaccucaagcucccacgacggaaauacagcugaccgacuacggagcucuuacacuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacauuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagauuccuuuuucgacccaagaugaaaaaggaguaacucagaaugggagauugauaacagccaaccccauaguuacugacaaagaaaagccagucaacauugaggcggaaccgccuuuuggugagaguuacauugugauaggagcaggugaaaaagcuuugaaacuaagcugguucaagaaaggaaguagcauagggaaaauguuugaggcaacugccagaggagcacgaaggauggcuauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucagggaaaaaaaaugauuaggccacaacccauggaauacaaauacucguggaaaagcuggggaaaggcuaaaaucauaggggcagauguacagaacaccaccuucaucaucgacggcccaaacaccccagaaugcccugaugaucaaagagcguggaacauuugggaaguugaggauuauggauuuggaauuuucacgacaaacauauggcugaaauugcgugacuccuacacccaagugugugaccaccggcuuaugucaucugccaucaaggacagcaaggcaguucacgcugacaugggguacuggauagaaagugaaaagaacgauaccuggaagcuggccagagccucuuucauagaagucaaaacauguauuuggccaaaaucccacacucuauggaguaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgagggccaucucuuaggaccacaacagucacaggaaagauaauccaugaaugguguugcagaucuuguacgcuaccacccuuacguuucagaggagaagaugggugcugguacgguauggaaaucagaccagucaaggaaaaggaagagaauuuagucaaaucaauggucucugcagggucaggggaaguggacagcuuuucacugggacugcuaugcauaucaauaaugaucgaagaggugaugagaucuagauggaguagaaaaaugcugaugauuggaacauuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaaucggauugagucuaguggcaucugcggaguuaccaaauuccuuggaggagcugggggacggacuugcaaugggcauuaugauuuugaaauuauugacugacuuucaaucacaucagcugugggcuacuuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuaugucauaucuggaaguucagccgaccuaucacuagagaaagcggcugaggucuccugggaagaagaagcagaacacucuggugcuucacacaacauauuaguggagguccaagaugauggaaccaugaagauaaaggaugaagagagagaugacacgcuaaccauucuccuuaaagcaacucugcuagcaguuucagggguguucccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggcccuuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuucugucucccgugagaguucccaauuauaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcaggaaaaccuuugacacagaguaccaaaaaacaaaaaauaaugacugggacuaugucgucacaacagacaucuccgaaaugggagcaaauuuccgggccgacagggugauagacccaagacggugucugaaaccgguaauacuaaaagaugguccagagcgcgucaucuuagcaggaccgaugccagugacuguggccagugcugcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggagaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggauguggagaucuggacaaaagaaggagaaagagagaaacuacgaccccgcuggcugggugccagaacauacucagacccacuggcuuugcgcgauuuuaaagaguuugcagcaggaagaagaagcgucucaggugaucuaauauuagaaauagggaaacuuccacaacacuugacgcaaagggcccaaaaugccuuggacaaccuggucauguugcacaacucccaacaaggaggaagagccuauacacaugcaauggaagaacugccagacaccauagaaacguugaugcuccuagcuuugauagcuguguuaacugguggagugacgcuguucuuccuaucaggaaggggccuagggaaaacauccaucggccuacucugcgugauggcuucaagcguacugcuauggauggccaguguagagccccauuggauagcggccucuaucauacuggaguucuuccugauggugcugcuuauuccagagccagacagacaacgcacuccgcaggacaaccagcuggcauauguggugauagguuuguuauucaugauacugacaguagcagcuaaugagaugggacugcuggaaaccacaaagaaagacuuagggauuggccauguggcuguugaaaaccaccaccaugccgcaaugcuggacguggacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucaaagauggacauaggaguuccacuucucgccuuggggugcuauucccaggugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguugcugauacuaugcacaucacagauccucuugaugcggacuacaugggccuugugcgaauccaucacguuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacggcugaaccaacugagcaagucagaauuuaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauauuauugcgcugggcugaagaaagucacagaagugaagggauauacaaaaggaggaccuggacaugaagaaccaaucccaauggcgaccuauggauggaaccuaguaaagcugcauuccgggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggagggaugcuagugcgaaauccacuuucaagaaauuccacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacacguggcaguggaaccagagguagccaaccuagauaucauuggccagaggauagagaacauaaaacaugaacacaagucaacauggcauuaugaugaggacaauccauacaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaggagaaaguugauacacgcacaccaaaagcaaaacgaggcacagcacaaaucauggaggugacagccaggugguuaugggguuuucuuucuagaaacaagaagccaagaauuuguacaagagaggaguucacaagaaaaguuaggucaaacgcagccaucggagcaguguucauugacgaaaaucaauggaacucagcaaaagaagcaguggaagaugagcgguucugggaccuugugcacagagagagagagcuucacaaacagggaaaaugugccacguguguuuauaacaugauggggaagagagagaaaaaguuaggagaguuuggaaaggcaaaaggaagucgugcaauaugguacaugugguugggagcacgcuuucuagaguucgaagcucuuggauucaugaacgaagaccacugguucagcagagagaauucacucaguggaguggaaggagaaggacuccacaaacuuggauacauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccaguugauaagacaaauggagucugagggaaucuuuucacccagugaauuagagaccccaaauuuagccgagagaguucuagacuggcugggaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugaucaugaaggaugggagggaaauaguggugccaugccgcaaccaagaugaacuuguggguagggcuagaguaucacaaggugcuggguggagccugagagaaaccgcaugccuaggcaaaucauaugcacaaauguggcagcugauguacuuccacaggagagaccugagacuagccgcuaaugccaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaauugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5309 - RNA, 9879 nt, Artificial Sequence
  derived and/or modified CDS sequence (wt) from DENV-1__KF971871__SS-prME
ucugugaccaugcuucuuaugcugaugcccacagccuuggcguuccauuugacuacacgagggggagagccgcacaugaugguuagcaagcaggaaagaggaaagucacuucuguuuaagaccucagcaggugucaacaugugcacccuuauagcgauggauuugggagaguuaugugaggacacaaugacuuacaaaugcccucgaaucacugaggcggaaccagaugauguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacauccaggauuuacggugauagcccucuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaauuuugugugucgacgaacguuuguggauagaggcuggggcaauggcugugggcucuucggaaaaggaagccuuauaacgugugcuaaguucaagugugugacaaaauuggaaggaaaaauaguucaauaugaaaacuugaaauauucaguaauugucaccguccacacuggagaccagcaccaagugggaaaugaaagcacagaacaugggacaacugcaacuauaacaccucaagcucccacgacggaaauacagcugaccgacuacggagcucuuacacuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacauuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagauuccuuuuucgacccaagaugaaaaaggaguaacucagaaugggagauugauaacagccaaccccauaguuacugacaaagaaaagccagucaacauugaggcggaaccgccuuuuggugagaguuacauugugauaggagcaggugaaaaagcuuugaaacuaagcugguucaagaaaggaaguagcauagggaaaauguuugaggcaacugccagaggagcacgaaggauggcuauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucagggaaaaaaaaugauuaggccacaacccauggaauacaaauacucguggaaaagcuggggaaaggcuaaaaucauaggggcagauguacagaacaccaccuucaucaucgacggcccaaacaccccagaaugcccugaugaucaaagagcguggaacauuugggaaguugaggauuauggauuuggaauuuucacgacaaacauauggcugaaauugcgugacuccuacacccaagugugugaccaccggcuuaugucagcugccaucaaggacagcaaggcaguucacgcugacaugggguacuggauagaaagugaaaagaacgauaccuggaagcuggcaagagccucuuucauagaagucaaaacauguauuuggccaaaaucccacacucuauggaguaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgagggccaucucuuaggaccacaacagucacaggaaagauaauccaugaaugguguugcagaucuuguacgcuaccacccuuacguuucagaggagaagaugggugcugguacgguauggaaaucagaccagucaaggaaaaggaagagaauuuagucaaaucaauggucucugcagggucaggggaaguggacagcuuuucacugggacugcuaugcauaucaauaaugaucgaagaggugaugagaucuagauggaguagaaaaaugcugaugauuggaacauuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaaucggauugagucuaguggcaucugcggaguuaccaaauuccuuggaggagcugggggacggacuugcaaugggcauuaugauuuugaaauuauugacugacuuucaaucacaucagcugugggcuacuuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuaugucauaucuggaaguucagccgaccuaucacuagagaaagcggcugaggucuccugggaagaagaagcagaacacucuggugcuucacacaacauauuaguggagguccaagaugauggaaccaugaagauaaaggaugaagagagagaugacacgcuaaccauucuccuuaaagcaacucugcuagcaguuucagggguguucccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggcccuuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuucugucucccgugagaguucccaauuauaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcaggaaaaccuuugacacagaguaccaaaaaacaaaaaauaaugacugggacuaugucgucacaacagacaucuccgaaaugggagcaaauuuccgggccgacagggugauagacccaagacggugucugaaaccgguaauacuaaaagaugguccagagcgcgucaucuuagcaggaccgaugccagugacuguggccagugcugcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggagaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaauaaccagguguuggaggagaacauggauguggagaucuggacaaaagaaggagaaagaaagaaacuacgaccccgcuggcugggugccagaacauacucagacccacuggcuuugcgcgaguuuaaagaguuugcagcaggaagaagaagcgucucaggugaucuaauauuagaaauagggaaacuuccacaacacuugacgcaaagggcccaaaaugccuuggacaaccuggucauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacauccaucggccuacucugcgugauggcuucaagcguacugcuauggauggccaguguagagccccauuggauagcggccucuaucauacuggaguucuuccugauggugcugcuuauuccagagccagacagacaacgcacuccgcaggacaaccagcuggcauauguggugauagguuuguuauucaugauacugacaguagcagcuaaugagaugggacugcuggaaaccacaaagaaagacuuagggauuggccauguggcuguugaaaaccaccaccaugccgcaaugcuggacguggacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucaaagauggacauaggaguuccacuucucgccuuggggugcuauucccaggugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguugcugauacuaugcacaucacagauccucuugaugcggacuacaugggccuugugcgaauccaucacguuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacggcugaaccaacugagcaagucagaauuuaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauauuauugcgcugggcugaagaaagucacagaagugaagggauauacaaaaggaggaccuggacaugaagaaccaaucccaauggcgaccuauggauggaaccuaguaaagcugcauuccgggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggagggaugcuagugcgaaauccacuuucaagaaauuccacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacacguggcaguggaaccagagguagccaaccuagauaucauuggccagaggauagagaacauaaaacaugaacacaagucaacauggcauuaugaugaggacaauccauacaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaggagaaaguugauacacgcacaccaaaagcaaaacgaggcacagcacaaaucauggaggugacagccaggugguuaugggguuuucuuucuagaaacaagaagccaagaauuuguacaagagaggaguucacaagaaaaguuaggucaaacgcagccaucggagcaguguucauugacgaaaaucaauggaacucagcaaaagaagcaguggaagaugagcgguucugggaccuugugcacagagagagagagcuucacaaacagggaaaaugugccacguguguuuauaacaugauggggaagagagagaaaaaguuaggagaguuuggaaaggcaaaaggaagucgugcaauaugguacaugugguugggagcacgcuuucuagaguucgaagcucuuggauucaugaacgaagaccacugguucagcagagagaauucacucaguggaguggaaggagaaggacuccacaaacuuggauacauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccaguugauaagacaaauggagucugagggaaucuuuucacccagugaauuagagaccccaaauuuagccgagagaguucuagacuggcugggaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugaucaugaaggaugggagggaaauaguggugccaugccgcaaccaagaugaacuuguggguagggcuagaguaucacaaggugcuggguggagccugagagaaaccgcaugccuaggcaaaucauaugcacaaauguggcagcugauguacuuccacaggagagaccugagacuagccgcuaaugccaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaauugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5310 - RNA, 9879 nt, Artificial Sequence
  derived and/or modified CDS sequence (wt) from DENV-1__KF971869__SS-prME
ucugugaccaugcuucuuaugcugaugcccacagccuuggcguuccauuugacuacacgagggggagagccgcacaugaugguuagcaagcaggaaagaggaaagucacuucuguuuaagaccucagcaggugucaacaugugcacccuuauagcgauggauuugggagaguuaugugaggacacaaugacuuacaaaugcccucgaaucacugaggcggaaccagaugauguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacauccaggauuuacggugauagcccucuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaauuuugugugucgacgaacguuuguggauagaggcuggggcaauggcugugggcucuucggaaaaggaagccuuauaacgugugcuaaguucaagugugugacaaaauuggaaggaaaaauaguucaauaugaaaacuugaaauauucaguaauugucaccguccacacuggagaccagcaccaagugggaaaugaaagcacagaacaugggacaacugcaacuauaacaccucaagcucccacgacggaaauacagcugaccgacuacggagcucuuacacuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacauuugaaauguagacuaaagauggacaaauugacucuaaaagggaugucauaugugaugugcacaggcucauucaagcuagagaaagaaguggcugagacccagcauggaaccguucuagugcagauuaaauacgaaggaacagaugcaccaugcaagauuccuuuuucgacccaagaugaaaaaggaguaacucagaaugggagauugauaacagccaaccccauaguuacugacaaagaaaagccagucaacauugaggcggaaccgccuuuuggugagaguuacauugugauaggagcaggugaaaaagcuuugaaacuaagcugguucaagaaaggaaguagcauagggaaaauguuugaggcaacugccagaggagcacgaaggauggcuauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucagggaaaaaaaaugauuaggccacaacccauggaauacaaauacucguggaaaagcuggggaaaggcuaaaaucauaggggcagauguacagaacaccaccuucaucaucgacggcccaaacaccccagaaugcccugaugaucaaagagcguggaacauuugggaaguugaggauuauggauuuggaauuuucacgacaaacauauggcugaaauugcgugacuccuacacccaagugugugaccaccggcuuaugucagcugccaucaaggacagcaaggcaguucacgcugacaugggguacuggauagaaagugaaaagaacgauaccuggaagcuggcaagagccucuuucauagaagucaaaacauguauuuggccaaaaucccacacucuauggaguaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgagggccaucucuuaggaccacaacagucacaggaaagauaauccaugaaugguguugcagaucuuguacgcuaccacccuuacguuucagaggagaagaugggugcugguacgguauggaaaucagaccagucaaggaaaaggaagagaauuuagucaaaucaauggucucugcagggucaggggaaguggacagcuuuucacugggacugcuaugcauaucaauaaugaucgaagaggugaugagaucuagauggaguagaaaaaugcugaugauuggaacauuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaaucggauugagucuaguggcaucugcggaguuaccaaauuccuuggaggagcugggggacggacuugcaaugggcauuaugauuuugaaauuauugacugacuuucaaucacaucagcugugggcuacuuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuaugucauaucuggaaguucagccgaccuaucacuagagaaagcggcugaggucuccugggaagaagaagcagaacacucuggugcuucacacaacauauuaguggagguccaagaugauggaaccaugaagauaaaggaugaagagagagaugacacgcuaaccauucuccuuaaagcaacucugcuagcaguuucagggguguucccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggcccuuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuucugucucccgugagaguucccaauuauaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcaggaaaaccuuugacacagaguaccaaaaaacaaaaaauaaugacugggacuaugucgucacaacagacaucuccgaaaugggagcaaauuuccgggccgacagggugauagacccaagacggugucugaaaccgguaauacuaaaagaugguccagagcgcgucaucuuagcaggaccgaugccagugacuguggccagugcugcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggagaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggauguggagaucuggacaaaagaaggagaaagaaagaaacuacgaccccgcuggcuggaugccagaacauacucagacccacuggcuuugcgcgaguuuaaagaguuugcagcaggaagaagaagcgucucaggugaucuaauauuagaaauagggaaacuuccacaacacuugacgcaaagggcccaaaaugccuuggacaaccuggucauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacauccaucggccuacucugcgugauggcuucaagcguacugcuauggauggccaguguagagccccauuggauagcggccucuaucauacuggaguucuuccugauggugcugcuuauuccagagccagacagacaacgcacuccgcaggacaaccagcuggcauauguggugauagguuuguuauucaugauacugacaguagcagcuaaugagaugggacugcuggaaaccacaaagaaagacuuagggauuggccauguggcuguugaaaaccaccaccaugccgcaaugcuggacguggacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucaaagauggacauaggaguuccacuucucgccuuggggugcuauucccaggugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguugcugauacuaugcacaucacagauccucuugaugcggacuacaugggccuugugcgaauccaucacguuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacggcugaaccaacugagcaagucagaauuuaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauauuauugcgcugggcugaagaaagucacagaagugaagggauauacaaaaggaggaccuggacaugaagaaccaaucccaauggcgaccuauggauggaaccuaguaaagcugcauuccgggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggagggaugcuagugcgaaauccacuuucaagaaauuccacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacacguggcaguggaaccagagguagccaaccuagauaucauuggccagaggauagagaacauaaaacaugaacacaagucaacauggcauuaugaugaggacaauccauacaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaggagaaaguugauacacgcacaccaaaagcaaaacgaggcacagcacaaaucauggaggugacagccaggugguuaugggguuuucuuucuagaaacaagaagccaagaauuuguacaagagaggaguucacaagaaaaguuaggucaaacgcagccaucggagcaguguucauugacgaaaaucaauggaacucagcaaaagaagcaguggaagaugagcgguucugggaccuugugcacagagagagagagcuucacaaacagggaaaaugugccacguguguuuauaacaugauggggaagagagagaaaaaguuaggagaguuuggaaaggcaaaaggaagucgugcaauaugguacaugugguugggagcacgcuuucuagaguucgaagcucuuggauucaugaacgaagaccacugguucagcagagagaauucacucaguggaguggaaggagaaggacuccacaaacuuggauacauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccaguugauaagacaaauggagucugagggaaucuuuucacccagugaauuagagaccccaaauuuagccgagagaguucuagacuggcugggaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugaucaugaaggaugggagggaaauaguggugccaugccgcaaccaagaugaacuuguggguagggcuagaguaucacaaggugcuggguggagccugagagaaaccgcaugccuaggcaaaucauaugcacaaauguggcagcugauguacuuccacaggagagaccugagacuagccgcuaaugccaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaauugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5311 - RNA, 9879 nt, Artificial Sequence
  derived and/or modified CDS sequence (wt) from DENV-1__JN903578__SS-prME
uccgugaccaugcuccucaugcugcugcccacugcccuggcguuccacuugaccacacgagggggagagccacacaugauaguuagcaagcaggaaagaggaaagucacucuuguuuaagaccucuguaggugucaauaugugcacucucauugcgauggauuugggagaguuaugugaagacacaaugaccuacaaaugcccccggaucacugaggcggaaccagaugauguugacugcuggugcaaugccacagacacauggguuaccuaugggacguguucucaaaccggcgaacaccgacgagacaaacguuccgucgcacuggccccacacgugggacuuggucuagaaacaagaacugaaacguggauguccucugaaggcgccuggaaacaaauacaaagaguggagacuugggcuuugcgacacccaggauucacggugauagcccuuuucuuggcacaugccauaggaacauccaucacucagaaagggaucauuuucauucugcugaugcugguaacaccaucaauggccaugcgaugcgugggaauaggcaacagagacuucguugaaggacugucaggagcaacguggguggacgugguacuggagcauggaagcugcgucaccaccauggcaaaaaauaaaccaacauuggacauugaacucuugaaaacggaggucacgaacccugccguccugcgcaaacugugcauugaagcuaaaauaucaaacaccaccaccgauucaagauguccaacacaaggagaagcuacacugguggaagaacaagacgcgaacuuugugugucgacgaacguucguggacagaggcuggggcaaugguugcggacuauuuggaaaaggaagccuacugacgugugcuaaguucaagugugugacaaaacuagaaggaaagguaguucaauaugaaaacuuaaaauauucagugauagucacuguccacacuggggaccagcaucaggugggaaacgagaccacagaacauggaacaauugcaaccauaacaccucaagcuccaacgucggaaauacagcugaccgacuacggagcccucacauuggacugcucaccuagaaccgggcuggacuuuaaugagaugguguuauugacaaugaaagaaaaaucauggcuuguccacaaacaaugguuucuagacuuaccacugccuuggacuucgggggcuucaacaucccaagagaccuggaacagacaggacuugcuggucacauucaagacagcucaugcaaagaagcaggaaguagucguacugggaucacaggaaggagcaaugcacacugcguugacuggggcgacagaaauccagacgucaggaacgacaacaaucuuugcaggacaccugaagugcagacuaaaaauggauaaacugacuuuaaaagggaugucauaugugaugugcacagguucauuuaagcuagagaaggaaguggcugagacccagcauggaacuguuuuagugcagguuaaauacgaaggaacagaugcaccaugcaagauccccuuuuugauccaagaugagaaaggagugacccagaaugggagauugauaacagccaauccuauaguuacugacaaagaaaaaccagucaacauugagacagaaccaccuuuuggugagagcuacaucgugguaggggcaggugaaaaagcuuugaaacuaagccgguucaagaaaggaagcagcauagggaaaauguucgaagcaaccgcccgaggagcacgaaggauggcuauccugggagacaccgcaugggacuucgguucuauaggaggaguguuuacgucugugggaaaacugauacaucagguuuuugggaccgcauaugggguucuguucagcgguguuucuuggaccaugaaaauaggaauagggauucugcugacaugguugggauuaaauucaaggagcacgucacuuucaaugacgugcauuacaguuggcauggucacacuguaccuaggagucaugguucaggcggacucgggauguguaaucaacuggaagggcagagaacucaaauguggaaguggcauuuuugucaccaaugaaguccacaccuggacagagcaauacaaauuucaggcugacuccccaaagagauugucagcagccauuggaaaggcaugggaggagggcguguguggaauccgaucagcuacgcgucuugagaacaucauguggaagcaaauaucaaaugaauuaaaccacaucuuacuugaaaaugacaugaaauucacagugguuguaggagaugcuaauggaauuuuggcccaagggaaaaaaaugauuagaccacaacccauggaacacaaauacucauggaaaaguuggggaaaagccaaaaucauaggagcagacauacagaacaccaccuucaucauugacggcccagauacuccagaaugucccgaugaccagagagcauggaacaucugggaaguugaggacuauggauucggaauuuucacgacaaacauauggcugaaauugcgugacuccuacacccaaaugugugaccaccggcuaaugucagcugccaucaaggacagcaaggcaguccaugcugauaugggguacuggauagaaagugaaaagaacgagaccuggaagcuagcgagagccuccuuuauagaaaucaagacaugcaucuggccgaaaucccacacucuauggaguaauggagucuuggaaagugaaaugauaauuccaaagauauauggaggaccaauaucucagcacaaccacagaccaggguauuucacacaaacagcaggcccauggcaccuaggcaaguuggaauuggauuuugaugugugugaagguaccacaguuguuguggaugaacauuguggaaaucgagguccaucucucagaaccacaacagucacaggaaagauaauccaugaaugguguugcagauccugcacgcuaccccccuuacgcuucagaggagaagacggauguugguauggcauggaaaucagaccagucaaggagaaggaagagaaucuagucaggucaauggucucugcagggucaggagaaguggauaguuuuucauugggacuacuaugcgugucaauaaugauugaagaaguaaugagauccagauggaguagaaagaugcugaugacuggaacacuggcuguuuucuuccuucuuauaaugggacaacugacauggaaugaucugaucagauuaugcaucaugguuggagccaaugucucagacagaauggggaugggaacaacguaccuagccuugauggccacuuucaaaaugagaccgauguucgcuguugggcuauuauuucgcagacuaacauccagagagguucuccuucuuacaauuggacuaagccugguggcauccgcggagcuaccaaauucuuuagaggagcuaggggacggacucgcaaugggcaucaugauguuaaaauuauugacugauuuucagucacaccaguuauggacuaccuuacugucucugacauucaucaaaacaacucuuucacuggauuaugcauggaagacaauaacuaugauacugucaaucguaucucucuuuccucuaugucuauccacgaccucucaaaaaacaacauggcuuccggugcuguuaggauccuuuggaugcaaaccacuaaccauguuucuuauaacagaaaacaaaauuuggggaaggaaaaguuggccccucaaugaaggaauuauggcuguuggaauagucagcauuuuacuaagcucacuccucaaaaaugacgugccacuagccggcccacuaauagcuggaggcaugcuaauagcauguuacgucauauccggaagcucagccgauuuaucauuggagaaagcggcugagguauccugggaagaggaagcagaacacucugguaccucacacaacauacuaguggagguccaagaugauggaaccaugaaaauaaaagaugaagagagagaugacacacucaccauacuccucaaagcaacucugcuggcagucucaggaguguacccaaugucaauaccagcaacucuuuuugugugguauuuuuggcagaaaaagaaacagagaucagggguguuaugggacacacccagcccuccggaaguggaaagagcaguucuugaugauggcauuuauagaaucuugcagagaggacuguugggcaggucccaaguaggagugggaguuuuccaagacggcguguuccacacaauguggcacgucaccaggggagcuguccuuauguaccaagggaagaggcuggaaccaagcugggccagugucaaaaaagacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccaucgcucaagccaaagcaucacaagaagggccucuaccagagauugaggacgagguguuuaagaaaagaaaccuaacaauaauggaccuacauccaggaucaggaaaaacaagaagauaucuuccagccauaguccgugaggccauaaaaaggaagcugcgcacgcuaaucuuggcucccacaagaguugucgccucugaaauggcagaggcgcucaaaggaaugccaauaagauaucagacaacagcaguaaagagugaacacacaggaagggagauagucgaccucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuucaugacagccacucccccaggaucgguggaggccuuuccacagaguaaugcaguuauccaagaugaggaaaaagacauuccugagagaucauggaacucaggcuacgacuggaucacugauuuuccaggcaaaacagucugguuuguuccaagcaucaaaucaggaaaugacauugccaacuguuuaagaaagaacggaaaacgggugauucaacugagcaggaaaaccuuugacacugaguaccagaaaacaaaaaacaaugauugggacuauguugucacaacagacauuuccgaaaugggagcaaauuuccgggccgacaggguaauagauccaaggcggugcuugaaaccgguaauacuaaaggaugguccagagcgcgucauucuagccggaccaaugccagugacuguggcuagugcugcccagaggagaggaagaauuggaaggaaccaaaacaaagaaggugaucaguacguuuacaugggacagccuuuaaauaaugauggggaucacgcucauuggacagaagcaaaaaugcuccuugacaauauaaacacaccagaagggaucaucccagcccucuuugagccagagagagaaaagagugcagcaauagacggggaguacagacugcggggagaagcaagaaaaacguucguggagcucaugagaagaggagaucuaccaguuuggcuauccuacaaaguugccucagaagguuuccaauauuccgacagaagauggugcuuugauggggaaaggaacaaccagguguuggaggagaacauggacguggagaucuggacaaaggaaggagaaagaaagaaauugcgaccccgcugguuggaugcuagaacuuacucugauccacuggcucugcgcgaguuuaaagaguucgcagcaggaagaagaagugucucaggugaccuaauauuggaaauaggaaaacuuccacaacauuugacgcugagagcccagaaugcuuuggauaacuuggucauguugcacaauuccgaacaaggcggaaaagccuacagacaugcuauggaggaacuaccagacaccauagaaacauugaugcuccuagccuugauagcugugcucacugguggagugacgcuguucuuccuaucaggaaaaggucuagggaaaacauccauuggccuacucugugugauggccucaagcgcacuguuauggauggccaguguggagccccauuggauagcggccuccaucauacuagaguucuuucugauggugcugcucauuccagagccagacagacagcgcacuccacaggacaaccaguuagcauauguggugauagguuuguuauucaugauacuuacaguggcagccaaugagaugggauuauuggaaaccacaaagaaagaccuggggauuggccauguagccgccgaaaaccaccaccaugcuacaaugcuggacguagaccugcguccagcuucagccuggacccucuacgcaguagccacaacaguuaucacccccaugaugagacacacaauugaaaauacaacagcaaauauuucccugacggccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggcuacuagagaagcucaaaaaaggacagcggccggaauaaugaaaaauccaaccguagacgggauuguugcaauagacuuggauccugugguuuaugaugcaaaauuugaaaaacagcuaggucaaauaauguuacugauacuuuguacaucacagauucucuugaugcggaccacaugggccuugugugaauccaucacacuggcuacuggacccuugaccacucucugggaggggucuccaggaaaauuuuggaauacuacgauagcaguguccauggcaaacaucuucagaggaaguuaucuagcaggagcaggucuggccuucucauugaugaaaucuuuaggaggaaguaggagagguacgggagcucaaggggaaacacugggagaaaaauggaaaagacagcuaaaccaacugagcaagucagaauuuaacaccuauaaaaggagcgggauuauggagguggacagauccgaagccaaagagggauugaaaagaggagaaacaaccaaacaugcagugucgagaggaacagccaaacugaggugguuuguggagaggaaccucgugaaaccagaagggaaagucauagaccucgguuguggaagagguggcuggucauauuauugcgcugggcugaagaaagucacugaagugaagggauauacaaaaggaggaccuggacaugaggagcccaucccaauggcgaccuauggauggaaccuaguaaagcuacacucuggaaaagauguguucuucauaccgccugaaaaaugugacacccucuugugugauaucggugaguccucuccgaauccaacuauagaagaaggaagaacguuacguguccuaaagaugguggaaccauggcucagaggaaaccaauucugcauaaaaaucuuaaauccuuacaugccaagugugguagaaacucuggagcaaaugcaaagaaaacauggagggaugcuagugcgaaacccacuuucaagaaauuccacccaugaaauguacuggguuucauguggaacaggaaacauugugucagcagugaacaugacauccagaauguuacugaaccgauucacaauggcccacaggaagccaacauaugaaagagacguggaccuaggcgcuggaacaagacauguggcaguggaaccagagguagccaaccuagauaucauuggccagaggauagagaauauaaaaaaugaacacaagucaacauggcacuaugaugaagacaauccauacaaaacaugggccuaucauggaucauaugaggucaagccaucaggaucagccucauccauggugaauggcguggugagauugcucaccaaaccaugggauguuauccccauggucacacaaauagccaugacugauaccacaccauucggacaacagaggguguuuaaagagaaaguugacacacgcacaccaagagcaaaacgaggcacagcacaaauuauggaggugacagccaagugguuaugggguuuccuuuccagaaacaaaaaacccagaaucugcacaagagaggaguucacaagaaaaguuaggucaaacgcagcaauaggagcuguguucguugaugaaaaccaauggaacucagcaaaagaagcaguggaagacgaaagguuuugggaucucgugcacagagagagggagcuccauaaacagggaaaaugugccacauguguuuacaacaugauggggaagagagagaaaaaauuaggagaguucggaaaagcaaaaggaagccgugcaauaugguacauguggcugggagcacgcuuucuagaguuugaagcccuugguuucaugaaugaagaucauugguucaguagagagaauucacuuaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggcuacaucaauuuuuaaacugaccuaccaaaauaagguggugagggugcaaagaccagcaaaaaguggaaccgugauggaugucauauccagacgugaccagagaggaaguggacaggucggaacuuauggcuuaaauacuuucaccaauauggagguccaauuaauaagacaaauggagucugaaggaaucuuuuuaccuagcgaauuggaaacucccaaucuagcuaagagaguucuugacugguuggagaaacauggugcugaaaggcugaaaaggauggcaauuagcggagaugauuguguggugaaaccaauugaugauagguucgcaacagccuuaacagcucugaaugauaugggaaaaguaagaaaagacauaccgcagugggaaccuucaaaaggauggaaugacuggcagcaagugccuuucuguucacaccacuuccaccagcugaucaugaaagaugggagggaaauaguggugccaugccgcaaccaagaugaacuugugggcagggcuagaguaucacaaggugccggauggagccugagagaaacugcuugccuaggcaagucauaugcacaaauguggcagcugauguacuuccacaggagagaccugagacuagcggcuaaugcuaucuguucagccgucccaguugauugggucccaaccagccgcaccaccuggucgauccaugcccaccaccaauggaugacaacagaagacauguuaucaguguggaauagggucuggauagaggaaaacccauggauggaggacaaaacucauguauccagcugggaagaaguuccauaccuagggaaaagggaagaucaaugguguggaucccugauaggcuugacagcgagggccaccugggcuaccaacauacaaguagccauaaaccaggugagaaggcucaucgggaaugagaauuaucuagauuacaugacaacaaugaagagauucaagaaugagagugaucccgaaggggcgcucugguaa

SEQ ID NO: 5312 - RNA, 9879 nt, Artificial Sequence
  derived and/or modified CDS sequence (wt) from DENV-1__JN903579__SS-prME
uccgugaccaugcuccucaugcugcugcccacagcccuggcguuccauuugaccacacgagggggagagccacacaugauaguuggcaagcaggaaagaggaaagucacucuuguuuaagaccucugcaggugucaacaugugcacccucauugcaauggauuugggagaguuaugugaggauacaaugaccuacaaaugcccccggaucacugaagcagaaccagaugauguugauugcuggugcaaugccacagacacaugggugaccuaugggacguguucucaaacuggcgaacaccgacgggauaaacguucagucgcauuggccccacauguggggcuuggucucgaaacaagaaccgaaacauggauguccucugaaggcgccuggagacagauacaaaaaguggagacuugggccuugagacacccaggauucacggugauagcccuuuuucuagcacaugccauaggaacauccaucacucagaaagggaucaucuucauuuugcugauguuggugacaccaucaauggccaugcgaugcgugggaauaggcaacagagacuucguugaaggacugucaggagcaacauggguggaugugguacuggagcauggaagcugcgucaccaccauggcaaaaaauaaaccaacauuggacauugaacucuugaagacggaggucacgaacccugccgucuugcgcaaacugugcauugaagcuaaaauaucaaacacuacuacugauucaagauguccaacacaaggagaagcuacacugguggaagaacaagacgcgaacuuugugugucgacgaacauucguggacagaggcugggguaauggcuguggacuauucgggaagggaagcuuacugacgugugcuaaguuuaagugugugacaaaacuugaaggaaagauaguucaauaugaaaacuuaaaauauucagugauagucacuguccacacuggggaccagcaccagguaggaaaugagacuacagaacauggaacaauugcaaccauaacaccucaagcucccacgucggaaauacagcugacugacuacggagcccuuacauuagacuguucaccuagaacagggcuggacuuuaaugagauggugcuguugacaaugaaagaaaaaucauggcuuguccacaaacaaugguuucuagacuuaccacugcccuggaccucgggagcuucaacaucucaagagacuuggaacagacaagaucugcuggucacauuuaagacagcucaugcgaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacgggcucauuuaagcuagagaaggaaguagcugagacccagcauggaacuguccuagugcagguuaaauaugaaggaacagaugcaccaugcaagauuccauuuucaacccaagaugagaaaggagugacccagaaugggagauugauaacagccaaucccauaguuacugacaaagaaaaaccagucaacauugaaacagaaccaccuuuuggugagagcuacaucgugauaggggcgggugaaaaagcuuugaaacuaagcugguucaagaaaggaagcagcauagggaaaauguucgaagcuaccgcccgaggagcacgaaggauggcuauccugggagacacagcaugggacuucgguuccauaggagggguguucacaucugugggaaaauugguacaccagguuuuuggaaccgcauaugggguuuuguucagcgguguuucuuggaccaugaaaauaggaauagggauucugcugacauggcuaggauuaaauucaaggagcacgucacucucgaugacgugcauugcaguuggcauggucacacuguaccuaggagucaugguucaagcggacacggggugugugaucaacuggaagggcagagaacuuaaauguggaaguggcaucuucgucacuaaugaaguccacacuuggacagagcaauauaaauuccaggcugacuccccaaaaagacuaucagcagccauugggaaggcaugggaggaaggcguguguggaauucgaucagccacacgccuugagaacaucauguggaagcaaauaucaaaugaauugaaccauauucuacuugaaaaugauaugaaauucacagugguuguaggagacgcuaauggaaucuugacccaaggaaaaaagaugauuaggccacaacccauggaacacaaauacucauggaaaagcuggggaaaagccaaaaucauaggagcagauacacagaauacuaccuucaucauagauggcccagacacuccagaaugccccgaugaccagagagcauggaacauuugggaaguugaggacuauggguuuggaauuuucacgacaaacauauggcugaaauugcgugacuccuacacccaaaugugugaucaccggcuaaugucagcugccaucaaggacagcaaggcaguccaugcugacaugggguacuggauagaaagugaaaagaacgagaccuggaagcuagcgagagcuuccuucauagaagugaagacaugcaucuggccaagaucccacacucuauggagcaauggagucuuggaaagugaaaugauaaucccaaagauauauggaggaccaauaucccagcacaacuacagaccaggguauuucacacaaacagcagggccauggcaccuaggcaaguuggaacuagacuuuaacuugugugaaggcaccacaguuguuguggaugaacauuguggaaaucgagguccaucucuuagaacuacaacagucacaggaaagauaauccaugaaugguguuguagguccugcacgcuaccccccuuacgcuucagaggagaagacggauguugguauggcauggaaaucagaccagucaaggagaaggaagagaaucuagucaggucaauggucucugcagggucaggagaaguggauaguuuuucauugggacuacuaugcgugucaauaaugauugaagaaguaaugagauccagauggaguagaaagaugcugaugacuggaacacuggcuguuuucuuccuucuuauaaugggacaacugacauggaaugaucugaucagauuaugcaucaugguuggagccaaugucucagacagaauggggaugggaacaacguaccuagccuugauggccacuuucaaaaugagaccgauguucgcuguugggcuauuauuucgcagacuaacauccagagagguucuccuucuuacaauuggacuaagccugguggcauccgcggagcuaccaaauucuuuagaggagcuaggggacggacucgcaaugggcaucaugauguuaaaauuauugacugauuuucagucacaccaguuauggacuaccuuacugucucugacauucaucaaaacaacucuuucacuggauuaugcauggaagacaauagcuaugauacugucaaucguaucucucuuuccucuaugucuauccacgaccucucaaaaaacaacauggcuuccggugcuguuaggauccuuuggaugcaaaccacuaaccauguuucuuauaacagaaaacaaaauuuggggaaggaaaaguuggccccucaaugaaggaauuauggcuguuggaauagucagcauuuuacuaagcucacuccucaaaaaugacgugccacuagccggcccacuaauagcuggaggcaugcugauagcauguuacgucauauccggaagcucagcugauuuaucauuggagagagcggcugaggucuccugggaagaggaagcagaacacucuggugccucacacaacauacuaguggagguccaagaugauggaacuaugaaaauaaaagaugaagagagagaugacacgcucacuauacuccucaaagcaacuuuguuggcgguuucagggguguacccaaugucaauaccagcaacccuuuuugugugguauuuuuggcagaaaaagaaacagagaucaggagucuugugggacacacccagcccuccagaaguggaaagagcaguucuugaugaugguaucuacagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagagggaaaaauaguaggucuuuauggaaaugggguggugacaacgaguggaaccuacgucagugccauugcccaagcuaaagcaucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaagggagauagucgaucucaugugccacgccacuuucaccaugcgucuccuaucuccagugagaguuccuaauuacaacaugauuaucauggaugaagcacacuuuaccgauccagccagcauagcggccagaggguacaucucaacccgaguggguaugggugaagcagcugcgaucuucaugacagccacucccccaggaucgguagaggccuuuccacagagcaaugcaguuauccaagaugaggaaagagacauuccugagagaucauggaacucaggcuacgacuggaucacugauuucccaggaaaaacagucugguuuguuccaagcaucaaaucaggaaaugacauugccaacuguuuaagaaagaaugggaaacgggugauccaauugagcagaaaaaccauugacacugaauaccagaaaacaaaaaacaaugauugggacuauguugucacaacagacauuuccgaaaugggagcaaauuuccgggccgacaggguaauagacccaaggcggugcuugaagccgguaauacuaaaagaugguccagagcgcgucauucuagccggaccaaugccagugaccgcggccagugcugcccagaggagaggaagaauuggaaggaaccaaaacaaggaaggugaccaguauauuuacaugggacagccuuuaaauaaugaugaggaucacgcccauuggacagaagcaaaaaugcuccuugacaauauaaacacgccagaagggauuaucccagcccucuuugagccagagagagaaaaaagugcagcaauagacggggaguacagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggauguggagaucuggacaaaagaaggagaaagaaagaaauugcgaccucgcugguuagaugccagaaccuacucugacccacuggcccugcgugaguuuaaagaauucgcagcaggaagaagaagugucucaggugaccuaauauuagaaauagggaaacuuccacagcauuugacgcuaagggcccaaaaugcuuuggacaacuuggucauguugcacaauuccgaacaagggggaaaagccuauagacaugcuauggaagaauuaccagacaccauagaaacauugaugcuacuagcuuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcucauuccagagccagacagacagcguacuccacaggacaaucaacuagcauauguggugauagguucguuauucaugauacugacaguggcagccaaugagaugggauuacuggaaaccacaaagaaagaccuggggauuggccauguagucgccgaaaaccaccaccaugcuacaacgcuagacauagacuuacauccagcuucagccuggacccucuaugcaguagccacaacaauuaucacucccaugaugagacacacaauugaaaacacaacggcaaauauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguugauguuaguggcucauuaugccauaaucggaccuggacugcaagcaaaagcuacuagagaagcccaaaaaaggacagcggccggaauaaugaaaaauccaacuguagacgggauuguugcaauagauuuggauccugugguuuaugaugcaaaauuugaaaaacagcuaggccaaauaauguuacuaauacucugcacaucacagauucuuuugaugcggacuacaugggccuuaugugaauccaucacacuggcuacuggacccuugaccacucucugggagggaucuccuggaaaauucuggaacaccacaauagcaguguccauggcaaacaucuucaggggaagcuaucuagcaggagcaggucuggccuucucauuaaugaaaucuuugggaggagguaggagagguacgggagcucaaggggagacauugggagaaaaauggaaaagacaacuaaaccaacugagcaagucagaauuuaauacuuacaaaaggaguggaauuauggagguggacagaucugaagccaaggagggacugaaaagaggagaaacaaccaaacaugcagugucgagaggaacagccaaacuuaggugguuuguggagaggaaccuugugaaaccagaagggaaagugauagaccucgguuguggaagagguggcuggucauauuacugugcugggcugaagaagguuacagaagugaagggauacacaaaaggaggacccggucaugaggaaccuaucccaauggcgacuuauggauggaacauagugaaacuacacuccggaaaggauguauucuuuacaccaccugagaaaugugacacccuuuugugugacauuggugaguccucuccgaauccaacuauagaagaaggaagaacguuacguguucuaaagaugguggaaccauggcucagaggaaaucaguuuugcauaaaaauccuaaauccuuacaugccaagugugguagaaacucuggagcaaaugcaaagaaaacauggagggaugcuagugcgaaacccacucucaagaaauucuacccaugaaauguacuggguuucauguggaacaggaaacauugugucggcagugaacaugacauccagaauguugcugaaucgguucacaauggcucacaggaagccaacguaugaaagagacguggacuuaggcgcuggaacaagacauguggcaguggaaccagagauagccaacuuagauauuauuggccagaggauagagaacauaaaaaaugaacauaagucaacauggcauuaugaugaggacaauccauacaaaacaugggccuaucauggaucauaugaggucaagccaucagggucagccucauccauggugaacggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacugccaagugguuguggggauuccucucuagaaauaaaaaacccagaaucugcacaagagaagaguucacaagaaaaguuaggucaaacgcagcaauuggagcaguguucguugaugaaaaccaauggaacucagcaaaagaagcaguggaagacgaaagguuuugggaccucgugcacagagagagggagcuucauaaacaaggaaaaugugccacgugugucuacaacaugauggggaaaagagagaaaaaacuaggagaguuuggaaaggcaaaaggaagucgugcaauaugguacaugugguugggagcacgcuuucuagaguuugaagcccuuggcuucaugaaugaagaccacugguucaguagggagaauucacucaguggaguggaaggagaaggacuauauaaacuuggauacauacucagagacauaucaaagauuccagggggaaauauguaugcagacgacacagcuggaugggacacaagaauaacagaggaugaucuucagaaugaggccaaaaucacugacaucauggaacccgaacaugcucuacuggcuacgucaaucuucaagcugaccuaucaaaauaaggugguaagggugcaaagaccagcaaaaaguggaaccgugauggacguuauauccagacgugaccagagaggaaguggacaggucggaacuuauggcuuaaacacuuucaccaacauggagguccaacuaauaagacagauggaaucugaaggaaucuuuucacccagcgaauuggaaaacucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaagugagaaaagacauaccgcaaugggaaccuucaaaaggauggaaugacuggcagcaagugccuuucuguucacaccauuuccaccaacugaucaugaaggaugggagggagauaguggugccaugccgcaaccaagaugaacuugugggcagggccagaguaucacaaggcgcuggguggagccugagagaaacugcuugccugggcaagucauaugcacaaauguggcagcugauguacuuccacaggagagaccugagacuggcggcuaaugccaucuguucagccguuccaguuaauugggucccaaccagccgcaccacuuggucgauccaugcccaucaccaauggaugacaacagaagauauguuaucaguguggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaaugagaauuauucagacuacacgacaucaaugaagagauucaagaaugagagugaucccgaaggagcccucugguaa

SEQ ID NO: 5313 - RNA, 9879 nt, Artificial Sequence
  derived and/or modified CDS sequence (wt) from DENV-1__JN903580__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcagaaccagaugauguugauugcuggugcaaugccacagacacaugggugaccuaugggacguguucucaaacuggcgaacaccgacgggauaaacguucagucgcauuggccccacauguggggcuuggucucgaaacaagaaccgaaacauggauguccucugaaggcgccuggagacagauacaaaaaguggagacuugggccuugagacacccaggauucacggugauagcccuuuuucuagcacaugccauaggaacauccaucacccagaaagggaucaucuucauuuugcugauguuggugacaccaucaauggccaugcgaugcgugggaauaggcaacagagacuucguugaaggacugucaggagcaacauggguggaugugguacuggagcauggaagcugcgucaccaccauggcaaaaaauaaaccaacauuggauauugaacucuugaagacggaggucacgaacccugccgucuugcgcaaacugugcauugaagcuaaaauaucaaacacuacuacugauucaagauguccaacacaaggagaagcuacacugguggaagaacaagacgcgaacuuugugugucgacgaacauucguggacagaggcugggguaauggcuguggacuauucgggaagggaagcuuacugacgugugcuaaguuuaagugugugacaaaacuugaaggaaagauaguucaauaugaaaacuuaaaauauucagugauagucacuguccacacuggggaccagcaccagguaggaaaugagacuacagaacauggaacaauugcaaccauaacaccucaagcucccacgucggaaauacagcugacugacuacggagcccuuacauuagacuguucaccuagaacagggcuggacuuuaaugagauggugcuguugacaaugaaagaaaaaucauggcuuguccacaaacaaugguuucuagacuuaccacugcccuggaccucgggagcuucaacaucucaagagacuuggaacagacaagaucugcuggucacauuuaagacagcucaugcgaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacgggcucauuuaagcuagagaaggaaguggcugagacccagcauggaacuguccuagugcagguuaaauaugaaggaacagaugcaccaugcaagauuccauuuucaacccaagaugagaaaggagugacccagaaugggagauugauaacagccaaucccauaguuacugacaaagaaaaaccagucaacauugaaacagaaccaccuuuuggugagagcuacaucgugauaggggcgggugaaaaagcuuugaaacuaagcugguucaagaaaggaagcagcauagggaaaauguucgaagcuaccgcccgaggagcacgaaggauggcuauccugggagacacagcaugggacuucggcuccauaggagggguguucacaucugugggaaaauugguacaccagguuuuuggaaccgcauaugggguuuuguucagcgguguuucuuggaccaugaaaauaggaauagggauucugcugacauggcuaggauuaaauucaaggaacacgucacucucgaugacgugcauugcaguuggcauggucacacuguaccuaggagucaugguucaagcggacacggggugugugaucaacuggaagggcagagaacuuaaauguggaaguggcaucuucgucacuaaugaaguccacacuuggacagagcaauauaaauuccaggcugacuccccaaaaagacuaucagcagccauugggaaggcaugggaggaaggcguguguggaauucgaucagccacacgccuugagaacaucauguggaagcaaauaucaaaugaauugaaccauauucuacuugaaaaugauaugaaauucacagugguuguaggagacgcuaauggaaucuugacccaaggaaaaaagaugauuaggccacaacccauggaacacaaauacucauggaaaagcuggggaaaagccaaaaucauaggagcagauacacagaauacuaccuucaucauagauggcccagacacuccagaaugccccgaugaccagagagcauggaacauuugggaaguugaggacuauggguuuggaauuuucacgacaaacauauggcugaaauugcgugacuccuacacccaaaugugugaucaccggcuaaugucagcugccaucaaggacagcaaggcaguccaugcugacaugggguacuggauagaaagugaaaagaacgagaccuggaagcuagcgagagcuuccuucauagaagugaagacaugcaucuggccaagaucccacacucuauggagcaauggagucuuggaaagugaaaugauaaucccaaagauauauggaggaccaauaucccagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaaugguguuguagguccugcacgcuaccccccuuacgcuucagaggagaagacggauguugguauggcauggaaaucagaccagucaaggagaaggaagagaaucuagucaggucaauggucucugcagggucaggagaaguggauaguuuuucauugggacuacuaugcgugucaauaaugauugaagaagugaugaaauccagauggaguagaaagaugcugaugacuggaacacuggcuguuuucuuccuucuuauaaugggacaacugacauggaaugaucugaucagauuaugcaucaugguuggagccaaugucucagacagaauggggaugggaacaacguaccuagccuugauggccacuuucaaaaugagaccgauguucgcuguugggcuauuauuucgcagacuaacauccagagagguucuccuucuuacaauuggacuaagccugguggcauccgcggagcuaccaaauucuuuagaggagcuaggggauggacucgcaaugggcaucaugauguuaaaauuauugacugauuuucagucacaccaguuauggacuaccuuacugucucugacauucaucaaaacaacucuuucacuggauuaugcauggaagacaauagcuaugauacugucaaucguaucucucuuuccucuaugucuauccacgaccucucaaaaaacaacauggcuuccggugcuguuaggauccuuuggaugcaaaccacuaaccauguuucuuauaacagaaaacaaaauuuggggaaggaaaaguuggccccucaaugaaggaauuauggcuguuggaauagucagcauuuuacuaagcucacuccucaaaaaugacgugccacuagccggcccacuaauagcuggaggcaugcugauagcauguuacgucauauccggaagcucagcugauuuaucauuggagagagcggcugaggucuccugggaagaggaagcagaacacucuggugccucacacaacauacuaguggagguccaagaugauggaacuaugaaaauaaaagaugaagagagagaugacacgcucacuauacuccucaaagcaacuuuguuggcgauuucagggguguacccaaugucaauaccagcaacccuuuuugugugguauuuuuggcagaaaaagaaacagagaucaggagucuugugggacacacccagcccuccagaaguggaaagagcaguucuugaugaugguaucuacagaaucuugcaaagaggacuguuggguaggucccagguaggagugggaguuuuucaagacggcguguuccgcacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagagggaaaaauaguaggucuuuauggaaaugggguggugacaacgaguggaaccuacgucagugccauugcccaagcuaaagcaucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaagggagauagucgaccucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuucaugacagccacucccccaggaucgguagaggccuuuccacagagcaaugcaguuauccaagaugaggaaagagacauuccugagagaucauggaacucaggcuacgacuggaucacugauuucccaggaaaaacagucugguuuguuccaagcaucaaaucaggaaaugacauugccaacuguuuaagaaagaacgggaaacgggugauccaauugagcagaaaaaccuuugacacugaauaccagaaaacaaaaaacaaugauugggacuauguugucacaacagacauuuccgaaaugggagcaaauuuccgggccgacaggguaauagacccaaggcggugcuugaagccgguaauacuaaaagaugguccagagcgcgucauucuagccggaccaaugccagugaccgcggccagugcugcccagaggagaggaagaauuggaaggaaccaaaacaaggaaggugaccaguauauuuacaugggacagccuuuaaauaaugaugaggaucacgcccauuggacagaagcaaaaaugcuccuugacaauauaaacacgccagaagggauuaucccagcccucuuugagccagagagagaaaaaagugcagcaauagacggggaguacagacugcggggagaagcaaggaaaacguucguggagcuaaugagaagaggggaucuaccaguuuggcuaucuuacaaaguugccucagaaggcuuucaguacuccgacagaagauggugcuuugacggggaaaggaacaaccagguguuggaggagaacauggauguggagaucuggacaaaagaaggagaaagaaagaaauugcgaccucgcugguuagaugccagaaccuacucugacccacuggcccugcgugaguuuaaagaauucgcagcaggaagaagaagugucucaggugaccuaauauuagaaauagggaaacuuccacagcauuugacgcuaagggcccaaaaugcuuuggacaacuuggucauguugcacaauuccgaacaagggggaaaagccuauagacaugcuauggaagaauuaccagacaccauagaaacauugaugcuacuagcuuugauagcugugcugacugguggaguuacguuguuuuuccuaucaggaaaaggucuagggaaaacauccauuggcuuacuuuguguaauggccucaaguguacuguuauggauggcaaguguggagccccacuggauagcggccuccaucauacuagaguuuuuucugauggugcugcucauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugcuacaaugcuagacauagacuuacauccagcuucagccuggacccucuaugcaguagccacaacaauuaucacucccaugaugagacacacaauugaaaacacaacggcaaauauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguugauguuaguggcucauuaugccauaaucggaccuggacugcaagcaaaagcuacuagagaagcccaaaaaaggacagcggccggaauaaugaaaaauccaacuguagacgggauuguugcaauagauuuggauccugugguuuaugaugcaaaauuugaaaaacagcuaggccaaauaauguuacuaauacucugcacaucacagauucuuuugaugcggacuacaugggccuuaugugaauccaucacacuggcuacuggacccuugaccacucucugggagggaucuccuggaaaauucuggaacaccacaauagcaguguccauggcaaacaucuucaggggaagcuaucuagcaggagcaggucuggccuucucauuaaugaaaucuuuaggaggagguaggagagauacgggagcucaaggggagacauugggagaaaaauggaaaagacaacuaaaccaacugagcaagccagaauuuaauacuuacaaaaggaguggaauuauggagguggacagaucugaagccaaggagggacugaaaagaggagaaacaaccaaacaugcagugucgagaggaacagccaaacuuaggugguuuguggagaggaaccuugugaaaccagaagggaaagugauagaccucgguuguggaagagguggcuggucauauuacugugcugggcugaagaagguuacagaagugaagggauacacaaaaggaggacccggucaugaggaaccuaucccaauggcgacuuauggauggaacauagugaaacuacacuccggaaaggauguauucuuuacaccaccugagaaaugugacacccuuuugugugacauuggugaguccucuccgaauccaacuauagaagaaggaagaacguuacguguucuaaagaugguggaaccauggcucagaggaaaucaguuuugcauaaaaauccuaaauccuuacaugccaagugugguagaaacucuggagcaaaugcaaagaaaacauggagggaugcuagugcgaaacccacucucaagaaauucuacccaugaaauguacuggguuucauguggaacaggaaacauugugucggcagugaacaugacauccagaauguugcugaaucgguucacaauggcucacaggaagccaacguaugaaagagacguggacuuaggcgcuggaacaagacauguggcaguggagccagagauagccaacuuagauauuauuggccagaggauggagaacauaaaaaaugaacauaagucaacauggcauuaugaugaggacaauccauacaaaacaugggccuaucauggaucauaugaggucaagccaucagggucagccucauccauggugaacggcguggugagauugcucaccaagccaugggauguuauccccauggucacacaaauagcuaugacugauaccacacccuucggacaacagaggguuuucaaagagaaaguugacacacgcacaccaagaccgaaacgaggcacagcacaaauuauggaggugacugccaagugguuguggggauuccucucuagaaauaaaaaacccagaaucugcacaagagaagaguucacaagaaaaguuaggucaaacgcagcaauuggagcaguguucguugaugaaaaccaauggaacucagcaaaagaagcaguggaagacgaaagguuuugggaccucgugcacagagagagggagcuucauaaacaaggaaaaugugccacgugugucuacaacaugauggggaaaagagagaaaaaacuaggagaguuuggaaaggcaaaaggaagucgugcaauaugguacaugugguugggagcacgcuuucuagaguuugaagcccuuggcuucaugaaugaagaccacugguucaguagggagaauucacucaguggaguggaaggagaaggacuauauaaacuuggauacauacucagagacauaucaaagauuccagggggaaauauguaugcagacgacacagcuggaugggacacaagaauaacagaggaugaucuucagaaugaggccaaaaucacugacaucauggagcccgaacaugcucuacuggcuacgucaaucuucaagcugaccuaucaaaauaaggugguaagggugcaaagaccagcaaaaaguggaaccgugauggacguuauauccagacgugaccagagaggaaguggacaggucggaacuuauggcuuaaacacuuucaccaacauggagguccaacuaauaagacagauggaaucugaaggaaucuuuucacccagcgaauuggaaaacucaaaucuagcugagagaguucucgacugguuggagaaacauggcgucgaaagguugaaaagaauggcaaucagcggagaugacuguguggugaaaccaacugaugacagguucgcaacagcuuuaacagcccugaaugacaugggaaaagugagaaaagacauaccgcaaugggaaccuucaaaaggauggaaugacuggcagcaagugccuuucuguucacaccauuuccaccaacugaucaugaaggaugggagggagauaguggugccaugccgcaaccaagaugaacuugugggcagggccagaguaucacaaggcgcuggguggagccugagagaaacugcuugccuaggcaagucauaugcacaaauguggcagcugauguacuuccacaggagagaccugagacuggcggcuaaugccaucuguucagccguuccaguuaauugggucccaaccagccgcaccacuuggucgauccaugcccaccaucaauggaugacaacagaagauauguuaucaguguggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaaugagaauuauucagacuacaugacaucaaugaagagauucaagaaugagagugaucccgaaggagcccucugguaa

SEQ ID NO: 5314 - RNA, 9879 nt, Artificial Sequence
  derived and/or modified CDS sequence (wt) from DENV-1__JN903581__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcagaaccagaugauguugauugcuggugcaaugccacagacacaugggugaccuaugggacguguucucaaacuggcgaacaccgacgggauaaacguucagucgcauuggccccacauguggggcuuggucucgaaacaagaaccgaaacauggauguccucugaaggcgccuggagacagauacaaaaaguggagacuugggccuugagacacccaggauucacggugauagcccuuuuucuagcacaugccauaggaacauccaucacccagaaagggaucaucuucauuuugcugauguuggugacaccaucaauggccaugcgaugcgugggaauaggcaacagagacuucguugaaggacugucaggagcaacauggguggaugugguacuggagcauggaagcugcgucaccaccauggcaaaaaauaaaccaacauuggauauugaacucuugaagacggaggucacgaacccugccgucuugcgcaaacugugcauugaagcuaaaauaucaaacacuacuacugauucaagauguccaacacaaggagaagcuacacugguggaagaacaagacgcgaacuuugugugucgacgaacauucguggacagaggcugggguaauggcuguggacuauucgggaagggaagcuuacugacgugugcuaaguuuaagugugugacaaaacuugaaggaaagauaguucaauaugaaaacuuaaaauauucagugauagucacuguccacacuggggaccagcaccagguaggaaaugagacuacagaacauggaacaauugcaaccauaacaccucaagcucccacgucggaaauacagcugacugacuacggagcccuuacauuagacuguucaccuagaacagggcuggacuuuaaugagauggugcuguugacaaugaaagaaaaaucauggcuuguccacaaacaaugguuucuagacuuaccacugcccuggaccucgggagcuucaacaucucaagagacuuggaacagacaagaucugcuggucacauuuaagacagcucaugcgaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacgggcucauuuaagcuagagaaggaaguggcugagacccagcauggaacuguccuagugcagguuaaauaugaaggaacagaugcaccaugcaagauuccauuuucaacccaagaugagaaaggagugacccagaaugggagauugauaacagccaaucccauaguuacugacaaagaaaaaccagucaacauugaaacagaaccaccuuuuggugagagcuacaucgugauaggggcgggugaaaaagcuuugaaacuaagcugguucaagaaaggaagcagcauagggaaaauguucgaagcuaccgcccgaggagcacgaaggauggcuauccugggagacacagcaugggacuucggcuccauaggagggguguucacaucugugggaaaauugguacaccagguuuuuggaaccgcauaugggguuuuguucagcgguguuucuuggaccaugaaaauaggaauagggauucugcugacauggcuaggauuaaauucaaggaacacgucacucucgaugacgugcauugcaguuggcauggucacacuguaccuaggagucaugguucaagcggacacggggugugugaucaacuggaagggcagagaacuuaaauguggaaguggcaucuucgucacuaaugaaguccacacuuggacagagcaauauaaauuccaggcugacuccccaaaaagacuaucagcagccauugggaaggcaugggaggaaggcguguguggaauucgaucagccacacgccuugagaacaucauguggaagcaaauaucaaaugaauugaaccauauucuacuugaaaaugauaugaaauucacagugguuguaggagacgcuaauggaaucuugacccaaggaaaaaagaugauuaggccacaacccauggaacacaaauacucauggaaaagcuggggaaaagccaaaaucauaggagcagauacacagaauacuaccuucaucauagauggcccagacacuccagaaugccccgaugaccagagagcauggaacauuugggaaguugaggacuauggguuuggaauuuucacgacaaacauauggcugaaauugcgugacuccuacacccaaaugugugaucaccggcuaaugucagcugucaucaaggacagcaaggcaguccaugcugacaugggguacuggauagaaagugaaaagaacgagaccuggaagcuagcgagagcuuccuucauagaagugaagacaugcaucuggccaagaucccacacucuauggagcaauggagucuuggaaagugaaaugauaaucccaaagauauauggaggaccuauaucccagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaaugguguuguagguccugcacgcuaccccccuuacgcuucagaggagaagacggauguugguauggcauggaaaucagaccagucaaggaggaggaagagaaucuagucaggucaauggucucugcagggucaggagaaguggauaguuuuucauugggacuacuaugcgugucaauaaugauugaagaagugaugaaauccagauggaguagaaagaugcugaugacuggaacacuggcuguuuucuuccuucuuauaaugggacaacugacauggaaugaucugaucagauuaugcaucaugguuggagccaaugucucagacagaauggggaugggaacaacguaccuagccuugauggccacuuucaaaaugagaccgauguucgcuguugggcuauuauuucgcagacuaacauccagagagguucuccuucuuacaauuggacuaagccugguggcauccgcggagcuaccaaauucuuuagaggagcuaggggauggacucgcaaugggcaucaugauguuaaaauuauuggcugauuuucagucacaccaguuauggacuaccuuacugucucugacauucaucaaaacaacucuuucacuggauuaugcauggaagacaauagccaugauacugucaaucguaucucucuuuccucuaugucuauccacgaccucucaaaaaacaacauggcuuccggugcuguuaggauccuuuggaugcaaaccacuaaccauguuucuuauaacagaaaacaaaauuuggggaaggaaaaguuggccccucaaugaaggaauuauggcuguuggaauagucagcauuuuacuaagcucacuccucaaaaaugacgugccacuagccggcccacuaauagcuggaggcaugcugauagcauguuacgucauauccggaagcucagcugauuuaucauuggagagagcggcugaggucuccugggaagaggaagcagaacacucuggugccucacacaacauacuaguggagguccaagaugauggaacuaugaaaauaaaagaugaagagagagaugacacgcucacuauacuccucaaagcaacuuuguuggcgauuucagggguguacccaaugucaauaccagcaacccuuuuugugugguauuuuuggcagaaaaagaaacagagaucaggagucuugugggacacacccagcccuccagaaguggaaagagcaguucuugaugaugguaucuacagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaagucggagccauagcccuagauuucaaaccuggcacaucuggaucucccaucgugaacagagagggaaaaauaguaggucuuuauggagaugggguggugacaacgaguggaaccuacgucagugccauugcccaagcuaaagcaucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacuggaagggagauagucgaccucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuucaugacagccacucccccaggaucgguagaggccuuuccacagagcaaugcaguuauccaagaugaggaaagagacauuccugagagaucauggaacucaggcuacgacuggaucacugauuucccaggaaaaacagucugguuuguuccaagcaucaaaucaggaaaugacauugccaacuguuuaagaaagaacgggaaacgggugauccaauugagcagaaaaaccuuugacacugaauaccagaaaacaaaaaacaaugauugggacuauguugucacaacagacauuuccgaaaugggagcaaauuuccgggccgacaggguaauagacccaaggcggugcuuggagccgguaauacuaaaagaugguccagagcgcgucauucuagccggaccaaugccagugaccgcggccagugcugcccagaggagaggaagaauuggaaggaaccaaaacaaggaaggugaccaguauauuuacaugggacagccuuuaaauaaugaugaggaucacgcccauuggacagaagcaaaaaugcuccuugacaauauaaacacgccagaagggauuaucccagcccucuuugagccagagagagaaaaaagugcagcaauagacggggaguacagacugcggggagaagcaaggaaaacguucguggagcuaaugagaagaggggaucuaccaguuuggcuaucuuacaaaguugccucagaaggcuuucaguacuccgacagaagauggugcuuugacggggaaaggaacaaccagguguuggaggagaacauggauguggagaucuggacaaaagaaggagaaagaaagaaauugcgaccucgcugguuagaugccagaaccuacucugacccacuggcccugcgugaguuuaaagaauucgcagcaggaagaagaagugucucaggugaccuaauauuagaaauagggaaacuuccacagcauuugacgcuaagggcccaaaaugcuuuggacaacuuggucauguugcacaauuccgaacaagggggaaaagccuauagacaugcuauggaagaauuaccagacaccauagaaacauugaugcuacuagcuuugauagcugugcugacugguggaguuacguuguuuuuccuaucaggaaaaggucuagggaaaacauccauuggcuuacuuuguguaauggccucaaguguacuguuauggauggcaaguguggagccccacuggauagcggccuccaucauacuagaguuuuuucugauggugcugcucauuccagagccagacaggcagcguacuccacaggacaaucaacuagcauauguggugauagguuuguuauucaugauauugacaguggcagccaaugagaugggauuacuggaaaccacaaagagagaccuggggauuggccauguagucgccgaaaaccaccaccaugcuacaaugcuagacauagacuuacauccagcuucagccuggacccucuaugcaguagccacaacaauuaucacucccaugaugagacacacaauugaaaacacaacggcaaauauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguugauguuaguggcucauuaugccauaaucggaccuggacugcaagcaaaagcuacuagagaagcccaaaaaaggacagcggccggaauaaugaaaaauccaacuguagacgggauuguugcaauagauuuggauccugugguuuaugaugcaaaauuugaaaaacagcuaggccaaauaauguuacuaauacucugcacaucacagauucuuuugaugcggacuacaugggccuuaugugaauccaucacacuggcuacuggacccuugaccacucucugggagggaucuccuggaaaauucuggaacaccacaauagcaguguccauggcaaacaucuucaggggaagcuaucuagcaggagcaggucuggccuucucauuaaugaaaucuuuaggaggagguaggagagguacgggagcucaaggggagacauugggagaaaaauggaaaagacaacuaaaccaacugagcaagucagaauuuaauacuuacaaaaggaguggaauuauggagguggacagaucugaagccaaggagggacugaaaagaggagaaacaaccaaacaugcagugucgagaggaacagucaaacuuaggugguuuguggagaggaaccuugugaaaccagaagggaaagugauagaccucgguuguggaagagguggcuggucauauuacugugcugggcugaagaagguuacagaagugaagggauacacaaaaggaggacccggucaugaggaaccuaucccaauggcgacuuauggauggaacauagugaaacuacacuccggaaaggauguauucuuuacaccaccugagaaaugugacacccuuuugugugacauuggugaguccucuccgaauccaacuauagaagaaggaagaacguuacguguucuaaagaugguggaaccauggcucagaggaaaucaguuuugcauaaaaauccuaaauccuuacaugccaagugugguagaaacucuggagcaaaugcaaagaaaacauggagggaugcuagugcgaaacccacucucaagaaauucuacccaugaaauguacuggguuucauguggaacaggaaacauugugucggcagugaacaugacauccagaauguugcugaaucgguucacaauggcucacaggaagccaacguaugaaagagacguggacuuaggcgcuggaacaagacauguggcaguggagccagagauagccaacuuagauauuauuggccagaggauagagaacauaaaaaaugaacauaagucaacauggcauuaugaugaggacaauccauacaaaacaugggccuaucauggaucauaugaggucaagccaucagggucagccucauccauggugaacggcguggugagauugcucaccaagccaugggauguuauccccauggucacacaaauagcuaugacugauaccacacccuucggacaacagaggguuuucaaagagaaaguugacacacgcacaccaagaccgaaacgaggcacagcacaaauuauggaggugacugccaagugguuguggggauuccucucuagaaauaaaaaacccagaaucugcacaagagaagaguucacaagaaaaguuaggucaaacgcagcaauuggagcaguguucguugaugaaaaccaauggaacucagcaaaagaagcaguggaagacgaaagguuuugggaccucgugcacagagagagggagcuucauaaacaaggaaaaugugccacgugugucuacaacaugauggggaaaagagagaaaaaacuaggagaguuuggaaaggcaaaaggaagucgugcaauaugguacaugugguugggagcacgcuuucuagaguuugaagcccuuggcuucaugaaugaagaccacugguucaguagggagaauucacucaguggaguggaaggagaaggacuauauaaacuuggauacauacucagagacauaucaaagauuccagggggaaauauguaugcagacgacacagcuggaugggacacaagaauaacagaggaugaucuucagaaugaggccaaaaucacugacaucauggagcccgaacaugcucuacuggcuacgucaaucuucaagcugaccuaucaaaauaaggugguaagggugcaaagaccagcaaaaaguggaaccgugauggacguuauauccagacgugaccagagaggaaguggacaggucggaacuuauggcuuaaacacuuucaccaacauggagguccaacuaauaagacagauggaaucugaaggaaucuuuucacccagcgaauuggaaaacucaaaucuagcugagagaguucucgacugguuggagaaacauggcgucgaaagguugaaaagaauggcaaucagcggagaugacuguguggugaaaccaacugaugacagguucgcaacagcuuuaacagcccugaaugacaugggaaaagugagaaaagacauaccgcaaugggaaccuucaaaaggauggaaugacuggcagcaagugccuuucuguucacaccauuuccaccaacugaucaugaaggaugggagggagauaguggugccaugccgcaaccaagaugaacuugugggcagggccagaguaucacaaggcgcuggguggagccugagagaaacugcuugccuaggcaagucauaugcacaaauguggcagcugauguacuuccacaggagagaccugagacuggcggcuaaugccaucuguucagccguuccaguuaauugggucccaaccagccgcaccacuuggucgauccaugcccaccaucaauggaugacaacagaagauauguuaucaguguggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaaugagaauuauucagacuacaugacaucaaugaagagauucaagaaugagagugaucccgaaggagcccucugguaa

SEQ ID NO: 5315 - RNA, 9879 nt, Artificial Sequence
  derived and/or modified CDS sequence (wt) from DENV-1__KX380796__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggagacagaugcaaaaaguggagacuugggccuugagacacccaggauucacggugauagcccuuuuucuagcacaugccauaggaacauccauuacccagaaagggaucaucuucauuuugcugaugcuggugacaccaucaauggccaugcggugcgugggaauaggcaacagagacuucguugaaggacugucaggagcaacauggguggaugugguacuggagcauggaagcugugucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagacaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucuguuggucacauucaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacucuaaaaggggugucauaugugaugugcacaggcucauuuaagcuagagaaggaaguggcugagacccagcauggaacuguccuagugcagguuaaauaugaaggaacagaugcaccaugcaagauuccauuuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucaacgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguacacacuuggacagagcaauauaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauaccaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccgguuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuuuacacaaacagcagggccauggcaccuaggcaaguuggaacuagacuuugauuugugugaaggcaccacaguuguuguggaugaacauuguggaaaucgagguccaucucuuagaaccacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucucauaaugggacaacugacauggaaugaucugaucagguuaugcaucaugguuggagccaaugucucagacagaauggggaugggaacaacguaccuagccuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagccacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccggugcuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauauccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccaggugggagugggaguuuuucaagacggcguguuccacacaauguggcaugucaccaggggggcuguccucauguaccaagggaagaggcuggaaccaaguugggccaguguaaaaaaagacuugaucucauauggaggagguuggagguuucaaggaucauggaacacgggagaagaaguacaggugauagcuguugaaccaggaaaaaacccaaagaauguacagacaacgccgggcaccuucaagaccccugaaggcgaagucggagccauagcccuagauuucaaaccuggcacaucuggaucucccaucgugaacagagagggaaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauaguugaccucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaacgcaguuauccaagaugaggaaagagacauuccugagagaucauggaacucaggcuacgacuggaucacugauuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgacaggguaauagacccaaggcggugcuugaagccgguaauacuaaaagauggcccagagcgcgucauucuagccggaccaaugccagugaccgcggccagugcugcccagaggagaggaagaauuggaaggaaccaaaacaaggaaggugaccaguauauuuacaugggacagccuuuaaauaaugaugaggaccacgcucacuggacagaagcaaaaaugcuccuugauaauauaaauacgccagaagggauuaucccagcccucuuugagccagagagagaaaagagugcagcaauagacggggaguauagacugcgaggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuggaugccagaaccuacucugauccacuggcccugcgcgaguuuaaagaguucgcagcaggaagaagaagugucucaggugaccuaauauuagagauagggaaacuuccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccugcuuuguguaauggccucaaguguacuguuauggauggccaguguggagccccauuggauagcggccuccaucauacuagaguuuuuucugauggugcugcucauuccagagccagacagacagcguacuccacaggacaaucaacuagcauauguggugauagguuuguuauucaugauauugacaguggcagccaacgagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcagcgguguugauguuaguggcucauuaugccauaaucggaccuggacugcaagcaaaagcuacuagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaagauucuggaauaccacgauagcaguguccauggcaaacaucuucaggggaaguuauuuagcaggagcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagaucugaagccaaggagggacugaaaagaggagaaacaaccaaacaugcagugucgagaggaacagccaaacuuaggugguuuguggagaggaaccuugugaaaccagaagggaaagugauagaccucgguuguggaagagguggcuggucauauuacugcgcugggcugaagaaggucacagaagugaagggauacacaaaaggaggacccggucaugaggaaccuaucccaauggcgacuuauggauggaacauagugaagcuacacucuggaagggauguauucuuuacaccaccugagaaaugcgacacccuuuugugugauauuggugaguccucuccgaauccaacuauagaagaaggaagaacguuacguguucuaaagaugguggaaccauggcucagaggaaaucaguuuugcauaaaaauccuaaauccuuacaugccaagugugguagaaacucuggagcaaaugcaaagaaaacauggagggaugcuagugcgaaacccacucucaagaaauucuacccaugaaauguacuggguuucauguggaacaggaaacauugugucggcagugaacaugacauccagaauguugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacaaggaaaaugugccacgugugucuacaauaugauggggaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucagcggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggccacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggaaauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaauccauggauggaggacaaaacucauguauccagcugggaagauguuccauacuuagggaaaagggaagaucaaugguguggaucucugauaggcuuaacagcaagagccaccugggccaccaacauacaaguggccauaaaccaagugagaaggcuuauugggaaugagaauuauuuagacuacaugacaucaaugaagagauucaagaaugagagugaucccgaaggagcccucugguaa

SEQ ID NO: 5316 - RNA, 9879 nt, Artificial Sequence
  derived and/or modified CDS sequence (wt) from DENV-1__KX380799__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggagcaggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagacuuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggccguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagagggaaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaacgcaguuauccaagaugaggaaagagacauuccugagagaucauggaacucaggcuacgacuggaucacugauuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgacaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcucauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagccucagccuggacccucuaugcaguagccacaacaauuaucacucccaugaugagacacacaauugaaaacacaacggcaaacauuucccugacagcuauugcaaaucaggcggccauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaagauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggaaauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 5317 - RNA, 9879 nt, Artificial Sequence
  derived and/or modified CDS sequence (wt) from DENV-1__KX380800__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggagcaggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuauuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaacgcaguuauccaagaugaggaaagagacauuccugagagaucauggaacucaggcuacgacuggaucacugauuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggaaauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 5318 - RNA, 9879 nt, Artificial Sequence
  derived and/or modified CDS sequence (wt) from DENV-1__KX380802__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggguaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggagcaggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaacgcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaaugcugcugaaucgguucacaauggcucacaggaagccaacguaugaaagagacguggauuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggaaauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 5319 - RNA, 9879 nt, Artificial Sequence
  derived and/or modified CDS sequence (wt) from DENV-1__KX380797__SS-prME
ucugugaccgugcuccucaugcugcugcccacagcccuagcguuucaucugaccacucggggaggagagccgcacaugauaguuaguaagcaggaaagaggaaaaucacuuuuguuuaagaccucuacaggugucaacauguguacccuuauugcaauggauuugggagaguuaugugaggacacaaugaccuacaaaugccccaggaucacugagacggagccagaugacguugacuguuggugcaaugccacggagacaugggugaccuauggaacauguucucaaacuggugaacaccgacgagacaaacguuccgucgcauuggcaccacacguagggcuuggccuagaaacaagaaccgaaacguggauguccucugaaggugcuuggagacaaauacaaaaaguggagacuugggcucugagacacccaggauucacggugauagcccuuuuucuagcacaugcuauaggaacauccaucacccagaaagggauuauuuuuauuuuguugaugcugguaacuccauccauggccaugcggugcgugggaauaggcaacagagacuucguggaaggacugucgggagcuacguggguggauguagugcuggagcauggaaguugcgucacuaccauggcaaaagacaaaccaacacuggacauugaacuccugaagacggaggucacaaacccugcaguccugcgcaaacugugcauugaagcuaaaauaucaaauaccaccaccgauucgagauguccaacacaaggagaagccacgcugguggaagagcaggacacgaacuucgugugccgacgaacgcucguggacagaggcuggggcaaugguugugggcuauuuggaaaagguaguuuaauaacgugugcuaaguuuaagugugugacaaaacuggaaggaaagauaguccaauaugaaaacuuaaaauauucagucauagucaccguacacacuggagaccaacaccaaguuggaaaugagaccacagaacauggaacaacugcaaccauaacaccucaagcuccuacgucggaaauacagcugacagacuacggagcucuaacacuggauuguucaccuagaacaggacuagacuuuaaugagaugguguuguugacgaugaaagaaaaaucauggcucguccacaaacaaugguuucuggaccuaccacugccuuggaccucaggggccucaacaucccaagagacuuggaauagacaagaccugcuggucacauucaagacagcucaugcaaaaaagcaggaaguagucgugcuaggaucacaagaaggagcaaugcacacugcgcugacuggagcgacagaaauccaaacgucuggaacgacaacaauuuuugcagggcaccuaaaaugcagacuaaaaauggauaaacugaccuuaaaagggguaucauauguaaugugcacagggucauuuaagcuagagaaggaaguggcugagacccagcauggaacuguucuagugcaaguuaaauacgaaggaacagaugcaccaugcaagauccccuucacgucccaagaugagaagggaguaacccagaaugggagauugauaacagccaaccccauagucacugacaaagaaaaaccagucaacauugaagcggagccaccuuuuggggagagcuaccuugugguaggagcaggugaaaaagcuuugaaacuaagcugguucaagaagggaagcaguauagggaaaauguuugaagcaacugcccgcggagcacgaaggauggccauccugggagacaccgcaugggacuucgguucuauaggagggguguucacaucugugggaaaacugauacaccagauuuuugggacugcguauggaguuuuguucagcgggguuucuuggaccaugaaaauaggaauagggauucugcugacauggcuaggauuaaauucaaggagcacaucccuuucaaugacguguaucgcagucggcauggucacacuguaccuaggagucaugguucaggcggacucgggauguguaaucaacuggaaaggcagagaacucaaauguggaagcggcauuuuugucaccaaugagguccacaccuggacagagcaauacaaauuccaggccgacucccccaagagacuaucagcggccauugggaaggcaugggaggagggugugugugggauccgaucagccacucgucucgagaacauuauguggaagcaaauaucaaaugaauuaaaccacaucuuacuugagaaugacaugaaauuuacaguggucguaggagacguuaauggaaucuuggcccaaggaaagaaaaugauuaggccgcaacccauggaacacaaauacucguggaaaagcuggggaaaagccaaagucauaggagcagauguacagaauagcaccuucaucaucgacggcccaaacaccccagaaugcccugaugaucaaagagcauggaauauuugggaagucgaagacuauggauuuggaauuuucacgacaaacauaugguugaaauugcgugacuccuacacucaagugugugaccaccggcuaaugucagcugccaucaaggauagcaaagcaguccaugcugacaugggguacuggauagagagugaaaagaacgagacuuggaaguugacaagagccuccuucauagaaguuaagacaugcgucuggccaaaaucccacacccuauggagcaauggagucuuggaaagugagaugauaaucccaaagauauauggaggaccaauaucucagcacaacuacagaccaggauauuucacacaaacagcaggaccguggcacuugggcaagcuagaacuggauuuugguuuaugugaagguaccacuguuguuguggaugaacauuguggaaaccgaggaccaucucuuagaaccacaacagucacagggaagauaauccaugaauggugcuguagaucuugcacguuaccccccuuacguuucaaaggagaagacgggugcugguacggcauggaaaucagaccagucaaggagaaggaagagaaccuagucaagucaauggucucugcagggucaggagaaguggacaguuuuucacuaggacugcuaugcauaucaauaaugaucgaagagguaaugagauccagauggagcaggaaaaugcugaugacuggaacacuggcuguguuccuccuucuuauaaugggacaguugacauggaaugaucugaucagacugugcaucaugguuggagcuaaugcuucagacaagauggggaugggaacgacguaccuagcuuugauggccacuuucagaaugagaccaauguucgcagucgggcuacuguuucgcagauuaacauccagagaaguucuucuuagaucaguuggauugagucuaguggcaucuguagaacuaccaaauuccuuggaggagcuaggggauggacuugcaaugggcauuaugauguugaaauuacugacugauuuucagucacaucagcuaugggcugccuugcugucuuuaacauuugucaaaacaacuuuuucauugcacuaugcauggaagacaauggcuaugauacugucaauuguaucucucuucccuuuaugccuguccacgacuucucaaaaaacaacauggcuuccgguguugcugggaucucuuggaugcaaaccacuaaccauguuucuuauuacagaaaacaaaaucuggggaagaaaaagcuggccucucaaugagggaauuauggcuguuggaauaguuagcauucuucuaaguucacuucuuaaaaaugauguaccacuagcuggcccacuaauagcuggaggcaugcugauagcauguuaugucauaucuggaagcucggccgauuuaucacuggagaaagcggcugaggucuccugggaagaagaagcagaacacucuggugccucacacaacauacuaguggagguccaagaugauggaaccaugaagauaaaagaugaagagagagaugacacacuuacuauucuccucaaagcaacucugcuagcaaucucagggguauacccaaugucaauaccggcgacccucuuugugugguauuuuuggcagaaaaagaaacagagaucaggagugcuaugggacacacccagcccuccagaaguggaaagagcaguccuugaugaugguauuuauagaauucuccaaagaggacuguugggcaagucucaaguagggguaggaguuuuucaagaagguguguuccacacaauguggcacgucaccaggggagcuguccucauguaccaagggaagagauuggaaccaaguugggccaguguuaaaaaagacuugaucucauauggaggagguuggagguuucaaggauccuggaacacgggagaagaagugcaggugauugcuguugaaccgggaaagaacccuaaaaauguacagacagccccggguacuuuuaaaaccccugaaggcgaaguuggagccauagcucuagacuuuaaacccggcacaucuggaucuccuauugugaacagagagggaaaaauaguaggucuuuauggaaauggaguggugacaacaaguggaaccuacgucagugccauagcucaagccaaagcaucacaagaaggaccucuaccagagauugaggacgagguguuuaggaaaagaaaccugacaauaauggaccuacauccaggaucgggaaaaacaagaagauaccuuccagccauaguccgugaggcuauaaaaagaaaacuacgcacgcuagucuuagcucccacaagaguugucgccucugaaauggcagaggcacucaagggaaugccaauaagguaccagacaacagcagugaaaagugaacacacgggaaaggagauaguugaccucaugugucacgccacuuuuaccaugcgucuccucuccccugugagaguucccaauuauaauaugauuaucauggaugaagcacauuucacugauccagccagcauagcagccagaggguauaucucaacccgaguggguaugggugaagcagcugcaauuuucaugacggccacuccccccggaucgauggaggccuuuccacagagcaaugcagcuauccaagaugaggaaagagauauuccugaaaggucuuggaacucaggcuaugacuggauuacugauuucccaggaaaaacaguuugguuuguuccaagcaucaaaucaggaaaugacauugccaacuguuugagaaagaaugggaaacgggugguccaauuaagcagaaaaaccuuugacacugaguaccagaagacaaaaaacaacgacugggacuauguugucacaacagacauauccgaaaugggagcaaacuuccgagcugacaggguaauagacccaaggcggugccuaaaaccgguaauacuaaaagauggcccagagcgugucauucuagccggaccgaugccagugacuguggcuagcgcugcccagaggagaggaagaauuggaaggaaccaaaauaaggaaggugaucaguauauuuacaugggacagccucugaacaaugaugaggaccaugcccauuggacagaagcaaaaaugcuccuugacaacauaaacacaccagaagggauuaucccagcccucuuugagccggagagagaaaagagcgcagcaauagacggggaauacagacuacggggugaagcgaggaaaaccuucguggagcuuaugagaagaggagaucuaccugucuggcuauccuacaaaguugccucagaaggcuuccaguacucugacagaagguggugcuuugauggagaaaggaacaaccaggugcuggaggagaacauggauguggagaucuggacaaaagaaggagaaagaaagaaacuacgaccccgcuggcuggacgccagaacauacucugacccacuggcucugcgcgaauucaaagaguucgcagcaggaagaagaagcgucucaggugaccuaauauuagaaauagggaaacuuccacaacaucuaacgcaaagggcccagaaugccuuggacaaccugguuaugcugcacaacucugaacaaggaggaaaagccuauagacacgccauggaagaacuaccagacacuauagaaacguuaaugcuucuggcuuugauagcuguguugacugguggggugacguuguucuuccuaucaggaaggggucuaggaaaaacauccauuggucuacucugcgugauggccucaagugcacuguuguggauggccaguguggaaccccauuggauagcggccucuaucauacuggaguucuuucugaugguguugcuuauuccagaaccggacagacagcgcacuccacaagacaaccagcuagcauacguggugauaggucuauuauucaugauauugacaguggcagccaaugagaugggauuacuggaaaccacaaagaaggaccuagggauuggccauguagcugcugaaagccaccaucaugcugcaaugcuggacguagaccuacauccagcuucagccuggacccuuuaugcaguggccacaacaauuaucacucccaugaugagacacacaauugaaaacacaacggcaaacaucucccugacagcuauugcaaaccaggcagcuauauugaugggacuugacaagggauggccaauaucaaagauggauauaggaguuccccuucuugccuuggggugcuauucucaggugaacccgcugacgcugacagcggcgguguugauguuaguggcucauuaugccauaauuggacccggacugcaagcaaaagcuacuagagaagcucaaaaaaggacagcagcuggaauaaugaaaaacccaacugucgaugggaucgucgcaauagauuuggacccugugguuuacgaugcaaaauuugaaaaacagcuaggccaaauaaugcuguugauacuuugcacaucacagauucuccugaugcggaccacaugggcuuugugugaauccaucacacuagccacuggaccucugaccacacucugggagggaucuccaggaaaauucuggaacaccacgauagcaguguccauggcaaacaucuuuaggggaagcuaucuagcaggagcaggucuggccuucucauuaaugaaaucucuaggaggagguaggagaggcacgggagcccaaggggaaacauugggagaaaaauggaaaagacagcugaaccaauugacuaagucagaauucaacacuuacaaaaggagugggaucauagagguggauagaucugaagccaaagagggguuaaaaagaggagaaacgacuaaacacgcggugucgagaggaacggccaaacugaggugguuuguagagaggaaccuugugaaaccagaagggaaagucauagaccucgguuguggaagagguggcuggucauauuauugcgcugggcugaagaaagucacagaagugaaaggauacacgaaaggaggaccugggcaugaggaaccaauuccaauggcaaccuauggauggaaccuaguaaaacuauacuccgggaaagauguauucuuuacaccaccugagaaaugugacacccucuugugcgauauuggugaguccucuccgaacccaaccauagaagaaggaagaacguuacguguccuaaagaugguggaaccauggcuuagaggaaaccaauuuugcauaaaaguucuaaaucccuacaugccgagcgugguagaaacuuuggagcaaaugcaaagaaaacauggaggaaugcuagugcgaaauccacucucaagaaacuccacucaugaaauguacuggguuucauguggaacaggaaauauugugucagcaguaaacaugacaucuagaaugcugcugaaucgauucacaauggcucacaggaaaccaacauaugaaagagacguggacuuaggcgcuggaacaagacauguggcaguagaaccagagguggccaaccuagauaucauuggccagaggauagaaaauauaaaaaaugaacacaaaucaacauggcauuaugaugaggauaauccauacaaaacaugggccuaucauggaucauaugaagucaagccaucaggaucagccucauccauggucaaugguguggugagacugcuaaccaaaccaugggaugucauccccauggucacacaaauagccaugacugacacuacacccuuuggacaacagaggguguucaaagagaaaguugacacgcgcacaccaaaagcgaagcgaggcacagcacaaauuauggaggugacagcuaggugguuauggggguuucuuucuagaaacaaaaaaccuagaaucuguacaagagaggaguucacaagaaaagucaggucaaacgcagcuauuggagcaguguucguugaugaaaaucaauggaacucagcaaaagaggcaguggaagaugaacgguucugggaccuugugcacagagagagggagcuucauaaacaaggaaagugugccacgugugucuacaacaugaugggaaagagagagaaaaaauuaggagaguuuggaaaggcaaaaggaagucgcgcaauaugguacaugugguugggagcgcgcuuuuuagaguuugaagcccuugguuucaugaaugaagaucauugguucagcagagagaauucacucaguggaguggagggagagggacuccacaaacuuggauacauacucagagacauaucaaagauuccagggggaaauauguaugcagaugacacagccggaugggacacaagaauaacagaggaugaucuucagaaugaggccaaaaucacugacaucauggaaccugaacaugcccuacuggccacgucaaucuucaagcuaaccuaccaaaacaagguaguaagggugcagagaccagcaaaaaauggaaccgugauggaugucauauccaggcgugaccagagaggaaguggacagguuggaaccuauggcuuaaacaccuucaccaacauggaggcccaacuaauaagacaaauggagucugagggaaucuuuuuacccagcgaauuggaaaccccaaaucuagcugaaagaguccuugacugguuggaaaaauauggcaucgagaggcugaaaagaauggcaaucaguggagaugacuguguggugaaaccaguugaugacagauucgcaacagccuuaacagcuuuaaaugacaugggaaagguaagaaaagacauaccacaaugggaacccucaaaaggauggaaugauuggcaacaagugcccuucuguucacaccauuuccaccagcugauuaugaaggacgggagggagauaguggugccaugccgcaaccaagaugaacuuguggguagggcuagaguaucacaaggcgccggauggagccugagagaaacugcaugccuaggcaagucauaugcacaaauguggcagcugauguacuuccacaggagagacuugagacuagcggcuaaugcuaucuguucagccgucccgguugauugggucccaaccagccgcaccacuuggucgauccaugcccaccaccaauggaugacaacagaagacauguugucaguguggaauaggguuuggauagaggaaaacccauggauggaagacaaaacucauguguccaguugggaagacguuccauaccuaggaaaaagggaagaucaaugguguggaucccuaauaggcuuaacagcacgagccaccugggccaccaacauacaaguggccauaaaccaagugagaaggcucauugggaaugagaacuaucuagacuacaugacaucaaugaagagauucaaaaacgagagugaucccgaaggggcacucugguga

SEQ ID NO: 5320 - RNA, 9879 nt, Artificial Sequence
  derived and/or modified CDS sequence (wt) from DENV-1__KX380805__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggagcaggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaagcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaacgcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggaaauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 5321 - RNA, 9879 nt, Artificial Sequence
  derived and/or modified CDS sequence (wt) from DENV-1__KX380798__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaagcagauacaaagaguggagacuugggcccugagacacccaggauucacggugauagcccuuuuuuuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagauguggugcuggaacauggaaguugugucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcacggaaccguucuagugcagauuaaauaugaaggaacagaugcaccaugcaagauccccuuuucaacccaagaugaaaaaggaguaacccagaaugggagauugauaacagcuaacccuauaguuacugacaaagaaaaaccagucaacauugaggcagaaccgccuuuuggugagaguuacaucgugauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcagauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucauggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugacuccuauacccaagugugugaccaccggcuaaugucagcugccaucaaggacagcaaggcaguucacgcugacaugggguacuggauagaaagugaaaagaaugagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacauaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucacaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucuaaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggcuagugucaaaaaagaccugaucucauauggaggagguuggaggcuucaaggauccuggaacacaggagaagaagugcagguaauugcuguugaaccagggaaaaaccccaaaaauguacaaacagcgccgggcaccuuuaagaccccugaaggugaaguuggagccauugcccuagauuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgacccauccaguauagcagccagaggguacaucucaacccgagugggcaugggugaagcagcugcaaucuucaugacagccacccccccaggauccguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccagagagagaaaagagugcagcaauagacggggaauacagacugcgaggugaggcaagaaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacgaagaaagacuuagggauuggccauguggcuguuggaaaucaccaccacgccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaauugagaugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauaaagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacagggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5322 - RNA, 9879 nt, Artificial Sequence
  derived and/or modified CDS sequence (wt) from DENV-1__KJ649286__SS-prME
uccgugaccaugcuccuuaugcugcugcccacagucuuggcguuucaucugaccacacgagggggagagccgcauaugauagucaccaagcaggaaagaggaaagucacuuuuguucaagaccucaacuggcgucaacaugugcacccuuauugcgauggacuugggagaguuaugugaggacacaaugacuuacaaauguccucgaaucacugaggcggaaccagaugacauugauuguuggugcaaugccacagacacaugggugaccuauggaacguguucccaaacuggcgagcaccgacgagacaaacguuccgucgcacuggcuccacacgugggacuuggucuagaaacaagaaccgaaacguggauguccucugaaggcgcuuggaaacaaauacaaagaguggagacgugggcccugagacacccaggauucacagugacagcccuuuuucuagcacaugccauaggaacauccaucacccagaaagggauuauuuucauuuuguugaugcugguaacaccauccauggccaugcgaugugugggaauaggcaacagggacuuuguggaaggacugucgggagcaacguggguagaugugguacuggaacauggaagcugugucaccaccauggcaaaagauaaaccaacauuggacauugaacuuuugaagacggaagucacaaacccugccguccugcgcaaacugugcauugaagccaaaauaucaaacaccaccaccgauucaagauguccaacacaaggagaagccacacugguggaagaacaagacgcgaauuuugugugucgacgaacguuuguggacagagguuggggcaauggcugugggcuuuucgggaaagguagccuaauaacgugugcuaaguuuaagugugugacuaaauuggaaggaaagauaguccaauaugaaaaccugaaauauucaguaauagucaccguccacacuggagaccagcaccaggugggaaaugaaagcacagaacaugggacaacagcaaccauaacaccucaagcucccacgucggaaauacagcugaccgacuacggagcucucacauuggacugcucaccuagaacaggacuagacuucaaugaaaugguguuguugacaaugaaagaaaaaucauggcuaguccacaaacaaugguuucuagaccuaccacugccuuggaccucgggagcuacaacgucacaagagacuuggaacagacaagauuugcugguaacauucaagacagcucaugcaaagaagcaggaaguggucgugcugggaucacaagaaggagcaaugcacacugcguugaccggagcgacagaaauccaaacgucugggacgacaacgauuuuugcaggacacuugaaauguagacuaaaaauggacaaacugacucuaaaagggaugucauaugugaugugcacaggcucauucaagcuagagaaagaggugguugagacccagcauggaaccguucuagugcagguuaaauacgaaggaacagaugcaccaugcaagaucccuuuuuugacccaagaugaaaaaggaguaacccagaaugggagagugauaacagccaacccuauagucacugacaaggaaaaaccagucaacauugaagcagaaccaccuuuuggugagaguuacaucgugguaggagcaggugaaaaagcuuugaaacuaagcugguucaagaaaggaagcaccauagggaaaauguuugaggcaacugcccgaggagcacgaaggauggccauacugggagacaccgcaugggacuuugguuccauuggaggaguguucacaucuguuggaaaacuaguacaccagauuuuuggaacugcauauggaguuuuguuuagcgguguuuccuggaccaugaaaauaggaauagggguucugcugacauggcuaggauuaaacucaaggagcacgucccuuucgaugacgugcauugcaguuggccugguaacacuguacuuaggagucaugguacaggcggacucgggaugugugaucaauuggaaaggcagagaacucaaauguggaaguggcauuuuugucaccaaugaaguucacacuuggacagagcaauacaaauuucaggcugacuccccaaaaagacuauccgcagccaucgggaaggcaugggaggaggguguguguggaauucgaucagccacucgucucgagaacaucauguggaagcaaauaucaaaugaacugaaccacaucuuacuugaaaaugacaugaaauucacaguggucguaggagauguuagugggaucuuggcccaagggaaaaaaaugauuaggccacagcccauggaacacaaauacucguggaaaagcuggggaaaagcuaaaaucauaggggcagauguacagaacuccaccuucaucauugacggcccaaacaccccagaaugcccugaugaucaaagagcauggaacauuugggaaguugaggacuauggauuuggaauuuucacgacaaacauaugguugaaauugcgugacuccuacacccaagugugugaccaccggcuaaugucagcugccaucaaggacagcaaggcaguucaugcugacaugggguacuggauagaaagugaaaagaacgagacuuggaagcuggcaagagcuuccuucauagaaguuaaaacaugcguuuggccaaaaucucacacucuauggagcaauggaguucuggaaagcgaaaugauaauuccaaagauauauggaggaccaauaucucagcacaacuacagaccaggauacuucacacaaacggcagggccguggcacuuaggcaaguuggaacuagauuuugauuugugugaggguacuacaguuguaguggaugaacauuguggaaaucgaggaccaucucuaagaaccacaacagucacaggaaaaauaauccaugaauggugcugcagaucuuguacgcuaccacccuuacguuucaaaggagaagauggguguugguaugguauggaaauuagaccagucaaggaaaaggaagagaaucuaguuaaaucaauggucucugcagggucaggagaaguggacagcuuuucacuaggacugcuaugcauaucaauaaugauugaagaggugaugagaucuagauggaguagaaaaaugcugaugacuggaacacuggcuguguuccuccuucucauaaugggacaauugacauggaaugaucugaucagguuaugcaucaugguuggagccaaugcuucagacaggauggggaugggaacaacguaccuagcccugauggccacuuuuaaaaugagaccaauguuugcugucgggcuauuguuccgcagacuaacaucuagagaaguucuucuccuuacaauuggauugagucuaguggcauccguggagcuaccaaauuccuuggaagagcugggggauggacuugcaaugggcauuaugaucuuaaaauuauugacugacuuucagucacaucagcugugggcugccuugcugucccugacauucaucaaaacaacuuguucuuugcacuaugcauggaagacaauggcuaugguacugucaauugugucucucuuccccuuaugcauguccacgaccucucaaaaaacaacauggcuuccggugcuauugggaucucuuggaugcaaaccacuaacuauguuucucauagcagaaaacaaaaucuggggaaggaaaaguuggccucucaaugaaggaaucauggcugucggaauagucagcaucuuacuaaguucacuccucaagaaugaugugccgcuagcugggccacuaguagcuggaggcaugcuaauagcaugcuauguuauaucuggaaguucagcugauuuaucacuagagaaagcggcugaggucuccugggaagaagaagcagaacacuccggugccucacacaauauauuaguggagguccaagaugauggaaccaugaagauaaaagaugaagagagagaugacacacuaaccauucuccuuaaagcaacucugcuggcaguuucagggguguacccauugucaauaccagcgacccuuuuugugugguauuuuuggcagaaaaagaaacagagaucaggaguguuaugggacacaccuagcccuccagaaguggaaagagcgguucuugaugaugguaucuauagaauuaugcagagaggacuguugggcagaucccaaguagggguaggaguuuuucaagaaaacguguuccacacaauguggcacgucaccaggggagcuguacucauguauaaagggaagagacuggaaccgacuugggcuagugucaaaaaagaccugaucucauauggaggagguuggaggcuucaaggauccuggaacacgggagaagaagugcaggugauugcuguugaaccggggaaaaaccccaaaaauguacagacagcgccgggcaccuucaagaccccugaaggugaagucggagccauagcccuagauuuuaaacccggcacaucuggaucccccauugugaacagagaggggaaaauaguaggucuuuauggaaauggaguagugacaacaaguggaaccuacgucagugccauagcucaagcuaaagcaucacaagaagggccccuaccagagauugaggacgaaguguuuaggaaaagaaacuuaacaauaauggaccuacauccaggaucgggaaaaacaagaagauaccuuccagccauaguccgugaggccauaaaaaggaagcugcgcacacuaauuuuggcucccacaagaguugucgcuuccgaaauggcagaggcgcucaagggaaugccaauaagguaucagacaacagcagugaagagugaacacacaggaaaggagauaguugaccucaugugccacgccacuuucacuaugcgucuucugucucccgugagaguucccaacuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggcuaugacuggaucacugacuucccagguaaaacagucugguuuguuccaagcauuaaaucgggaaaugacauugccaacuguuuaagaaagaaugggaaacgggugauucaauugaguaggaaaaccuuugacacugaguaccaaaagacaaaaaacaacgacugggacuaugucgucacaacagacaucuccgaaaugggagcuaacuucagagccgacaggguaauagacccaagacggugucugaaaccgguaauacuaaaagaugguccagagcgugucauucuagcaggaccgaugccagugacuguggccagugcugcccagaggagaggaagaaucggaaggaaccaaaauaaggaaggugaucaguacaucuacaugggacagccuuuaaacaacgaugaagaccacgcucauuggacagaagcaaaaaugcuccuugauaauauaaacacuccagaagggauuaucccagcccucuuugaaccggagagagaaaagagugcggcaauagacggggaauauagacugcggggugaagcaaggaaaacauuuguggagcucaugagaagaggagaucuaccugucuggcuauccuacaaaguugccucagaaggcuuccaguacucugacagaagauggugcuuugauggggaaaggaacaaucagguguuggaggagaacauggacguagagaucuggacaaaagaaggagaaagaaagaaacuacgaccccgcuggcuugaugccagaacauacucagacccauuggcccugcgcgaguuuaaagaguuugcagcaggaagaagaagcgucucaggugaucuaauauuagaaauaggaaaacuuccacagcaccugacgcaaagggcccagagugccuuggacaaccuggucauguugcacaacuccgaacaaggaggaagagccuacagacaugcaauggaagaacucccagacaccauagaaacguugaugcuccuagcuuugauagcuguguuaacugguggagugacgcuguucuuccuaucaggaaagggcuuagggaaaacauccaucggccuacuuugcgugauggcuucaagcaugcuauuauggauggccaguguggagccccauuggauagcggccuccaucauacuggaguucuuccugauggugcugcuuauuccagagccagacagacaacgcacuccacaggacaaccaguuggcauauguagugauagguuuguuauucaugauacugacaguagcagccaaugagaugggauuacuggaaaccacaaagaaagacuuagggauuggccauguggcuguugaaaaucaccaccaugccacaaugcuggacguagacuuacauccagcuucagccuggacccuuuaugcaguggccacaacaauuauuacucccaugaugaggcacacaaucgaaaacacaacggcaaacauuucccugacagcuauugcaaaccaggcagccauauugaugggacucgacaaaggauggccaauaucgaagauggacauaggaguuccacuucucgccuuggggugcuacucccaggugaacccaaugacgcugacagcggcaguauugaugcuaguggcucauuacaccauaauuggaccuggacugcaagcaaaagcuacaagagaagcccaaaaaaggacagcggccggaauaaugaagaauccaacugucgauggaauaguugcaauagauuuggacccugugguuuaugaugcaaaauuugagaaacaacuaggccaaauaauguuguugauacugugcacaucacagauccucuugaugcggacuacaugggcccugugugaauccaucacacuggcuacuggaccucugaccacgcuuugggagggaucuccaggaaaauuuuggaacaccacgauagccguguccauggcaaacauauucagaggaaguuaucuagcaggagcaggccuggccuucucacuaaugaaaucucuaggaggagguaggagagguacgggagcccaaggggaaacauugggagaaaaauggaaaagacagcuaaaccaacugagcaagucagaauucaacacuuacaaaaggagugggaucauagaaguggauagauccgaagccaaagagggacugaaaagaggagaaacaaccaaacaugcagugucgagaggaaccgccaaacugaggugguuuguggagaggaaccuugugaaaccagaagggaaagucauagaccuugguuguggaagagguggcuggucauauuauugcgccgggcugaagaaagucacagaagugaagggauacacaaaaggaggagcuggacaugaggaaccaaucccaauggcgaccuauggauggaaccuaguaaagcuacacuccgggaaagacguauucuuuauaccaccugaaaaaugugacacccuuuugugugacauuggugaguccucuccgaacccaaccauagaagaaggaagaacguuacguguccuaaagaugguggaaccauggcuccgaggaaaccaauuuugcauaaagauucuaaaccccuacaugccaagugugguggaaacucuggagcagaugcaaagaaaacauggaggaaugcuagugcgaaauccacuuucaagaaauuccacucaugaaauguauuggguuucauguggaacaggaaacauugugucagcaguaaacaugacauccagaauguugcuaaaucgauucacaauggcucacaggaaaccaacauaugaaagagacguggacuuaggagcuggaacaagacauguggcaguggaaccagagguagcuaaccuagauaucauuggccagaggauagagaacauaaaacaugaacacaagucaacauggcauuaugaugaggacaauccauacaagacaugggcuuaucauggaucauaugaggucaagccaucaggaucagccucauccauggucaauggcguggugagacugcucaccaaaccaugggaugucauucccauggucacacaaauagccaugacugacaccacacccuuuggacaacagaggguguuuaaagagaaaguugacacgcgcacaccaaaagcgaaacgaggcacagcacaagucauggaggugacagcuagguggcuaugggguuuucuuucuagaaacaaaaaaccaagaaucugcacaagagaggaguucacaagaaaaguuaggucaaacgcagccauuggagcaguguucguugaugaaaaucaauggaacucugcaaaagaagcaguggaagaugagcgguucugggaccuugugcacagagagagggagcuucacaaacagggaaaaugugccacauguguuuacaauaugauggggaaaagagagaaaaaacuaggagaguuuggaaaggcaaaaggaagucgugcaauaugguacaugugguuaggagcacgcuuucuagaguuugaagcccuugguuucaugaacgaagaucacugguucaguagagagaauucacucaguggaguggaaggagaaggacuccacagacucggauacauacuuagagacauaucaaagauuccagggggaaacauguaugcagaugacacagccggaugggauacaaggauaacagaggaugaucuucagaaugaagccaagaucacugacaucauggagcccgaacaugcccugcuagcuacgucaaucuucaagcugaccuaccaaaauaagguggugagggugcagagaccagcaaaaaauggaaccgugauggauguuauauccagacgugaccagagaggaaguggccaggucggaacuuauggcuuaaacacuuucaccaacauggaggcccagcuaauaagacaaauggagucugagggacucuuuucacccagcgaacuagagaccccaaacuuggccgagagaguucucaacugguugggaaaauauggcgucgaaaggcugaaaagaauggcaaucagcggagaugacugcguugugaaaccaauugacgacagguucgcaacagcccuaacagcucuaaacgauauggggaaagugaggaaagacauaccacaaugggaaccuucaaaaggauggaaugacuggcaacaagugccuuuuuguucacaccauuuccaccagcugauuaugaaggaugggagggaaauaguggugccaugccgcaaccaagaugaacuuguggguagggcuagagugucacaaggugccggauggagccugagagaaacugcaugccuaggcaagucauaugcacaaauguggcagcugauguacuuccacaggagagaccugagacuagcugcuaaugccaucuguucagccguuccaguugauugggucccaaccagccgcaccacuuggucgauccaugcccaucaucaauggaugacaacagaaaacauguugucaguguggaauaggguuuggauagaggaaaacccauggauggaggacaaaacccauguguccaguugggaagauguuccauauuuagggaaaagggaagaucaguggugugguucccugauaggcuuaacagcaagggccaccugggccacuaacauacaaguggcuauaaaccaagugagaaagcuaauugggaaugagaauuaccuagauuauaugacaucaaugaagagauucaagaacgauagcgaucccgaaggggcacucugguga

SEQ ID NO: 5323 - RNA, 9879 nt, Artificial Sequence
  derived and/or modified CDS sequence (wt) from DENV-1__KF887994__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacuuuugaagacggaagucacaaacccugccauccugcgcaaacugugcauugaagcuaaaauaucaaacaccaccaccgacucaagaugcccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaaugcuugaggcaacugccagaggagcucgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugacaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaacugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggaguaauggaguucuggaaagugaaaugauaauuccaaagaucuauggaggaccaauaucucagcacaacuacagaccaggauauuucacacaaacagcagggccguggcaccugggcaaguuggaacuggauuuugauuugugugagggcaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaauaggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaauggcaucuguggaguuaccaaauuccuuggaggagcugggggauggacuugcaaugggcauuaugauuuuaaaauuacugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaagaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguauccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggcuagugucaaaaaagaccugaucucauauggaggagguuggaggcuucaaggauccuggaacacaggagaagaagugcagguaauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauuuuggcucccacaaggguugucgcuuccgaaauggcagaggcgcucaagggaaugccaauaagguaccaaacaacagcaguaaagagugaacacacaggaaaagagauaguugaucucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagcagacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugacaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggcuuagggaaaacaucuauuggccuacucugcguaauggcuucaagcguacugcuauggauggccaguguagagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaagugaauccacugacgcugacagcggcgguauugaugcuaguggcucauuacgccauaauuggaccuggacugcaagcaaaagcuacuagagaagcucaaaaaaggacagcggccgggauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagcaaaagagggauugaaaagaggagaaacaaccaaacaugcagugucgagaggaaccgcuaaacugagaugguuuguggagaggaaccuugucaaaccagaagggaaagucauagaccucggcuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccuccccaaacccaacuauagaggaaggaagaacgcuacgcguccuaaagaugguggaaccauggcucagaggaaaccaauuuugcauaaagauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacaugguauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauaaagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucauucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucguauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgccuggcuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguuaauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaaaacuaauugggaaugagaauuaccuagauuacaugacaucaaugaagagauucaagaacgagagugaucccgaaggggcacucugguga

SEQ ID NO: 5324 - RNA, 9879 nt, Artificial Sequence
  derived and/or modified CDS sequence (wt) from DENV-1__JQ675358__SS-prME
uccgugaccaugcuucucaugcugcugcccacagcccuggcguuccauuugaccacacgagggggagagccacacaugauaguuaguaagcaggaaagaggaaagucacucuuguuuaagaccucugcuggugucaauaugugcacucucauugcgauggacuugggagaguuaugugaggacacaaugaccuacaaaugcccccagaucacugaggcggaaccagaugauguugacugcuggugcaaugccacagacacaugggugaccuaugggacguguucucaaaccggcgaacaccgacgagacaaacgcuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauucugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccagccaucuugcgcaaacugugcauugaagcuaaaauaucaaacaccaccaccgauucaagauguccaacacaaggagaggcuacauugguggaagaacaagaugcgaacuuugugugucgccgaacguuuguggacagaggcuggggcaauggcuguggacuauucggaaagggaagccuauugacgugugccaaguucaagugugugacaaaacuagaaggaaagauaguucaauaugaaaaccuaaaauauucagugauagucacuguccacacuggggaccagcaccaggugggaaacgagacuacagaacauggaacaauugcgaccauaacaccucaagcucccacgucggaaauacagcugaccgacuacggagcccucacauuggacugcucaccuagaacagggcuggauuuuaaugagauggugcuauugacaaugaaagaaagaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagacugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcaugguuacacuauaccuaggagucaugguucaagcggacucgggaugugugaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaacggaauuuuggcccaaggaaaaaaaaugauuaggccacaacccauggaacacaaauacucauggaaaagcuggggaaaagcuaaaauuauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuuaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggagucuuggaaagugaaaugauaaucccaaagacauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuucucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuauguaucaugguuggagcuaaugcuucagacaggauggggaugggaacaacguaccuagccuugauggcuacuuucaaaaugagaccaauguuugcuguugggcuauuauuucgcagacuaacauccagagaaguucuucuucucacgauuggauuaagcuugguggcauccguggagcuaccaaauucuuuagaggagcuaggggauggacuugcaauggguaucaugauguugaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaaccauguuucuuauaacagaaaacaaaaucuggggaaggaaaaguuggccccucaaugaaggaauuauggcuauuggaauaguuagccuucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacucguuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugauuucauauggaggagguuggagguuucaaggaucauggaacacgggagaagaagugcaggugauagcuguugaaccaagaaaaaaccccaaaaauguacagacaacgccggguaccuucaagacuccugaaggugaaguuggagccauagcucuagauuuuaaacccggcacaucuggaucccccaucgugaauagagagggaaaaauaguaggucuuuauggaaauggaguggugacaacaaguggaaccuacguuagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugaccguggcuagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaagaaacaaccagguguuggaggagaacauggacguggagaucuggacaaaggaaggagaaagaaagaaauuacgaccccgcugguuggacgccagaacauacucugauccguuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcguacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugauacaaaauuugaaaaacagcuaggccaaauaauguuacugauacuuuguacaucacagauccucuuaaugcggaccacaugggccuugugugaauccaucacauuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuguaggaggagguaggagagguaugggagcucaaggggaaacacugggagagaaauggaaaagacaguuaaaccaacugaguaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuucaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucagggucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaauuugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacguguguuuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggaugucauauccagacgugaccagagaggaaguggacaggucggaacuuauggcuuacauacuuucacuaacauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcucugaaugacaugggaaaaguaagaaaagacauaccgcagugggaaccuucaaaaggauggaaugauuggcagcaagugccuuucuguucacaccauuuccaccagcuaaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacccauguauccaguugggaagaagucccauaccuagggaaaagggaagaucaaugguguggauccuugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5325 - RNA, 9879 nt, Artificial Sequence
  derived and/or modified CDS sequence (wt) from DENV-1__FJ850070__SS-prME
uccgugaccaugcuccucaugcugcugcccacagcccuggcguuccauuugaccacacgagggggagagccacacaugauagucagcaagcaggaaagaggaaagucacucuuguuuaagaccucuguaggugucaacaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccgucgcacuggccccacacgugggacuuggucuagaaacaagaacugaaacguggauguccucugaaggcgccuggaaacaaauacaaaaaguggagacuugggcuuugcgacacccaggauucacggugauagcccuuuucuuggcacaugccauaggaacauccaucacucagaaagggaucauuuucauuuugcugaugcugguaacaccaucaauggccaugcgaugcgugggaauaggcaauagagacuucguugaaggacugucaggagcaacguggguggacgugguacuggagcauggaagcugcgucaccaccauggcaaaaaacaaaccaacauuggacauugaacucuugaaaacggaggucacgaacccugccguccugcgcaaacugugcauugaagcuaaaauaucaaacaccaccaccgauucaagauguccaacacaaggagaagccacacugguggaagaacaagacgcgaacuuugugugucgacggacguucguggacagaggcugggguaauggcugcggacuauuuggaaaaggaagucuacugacgugugcuaaguucaagugugugacaaaacuagaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagacuuaccacugccuuggacuucgggagcuucaacaucccaagagacuuggaacagacaagauuugcuggucacauucaagacagcucaugcaaagaaacaggaaguagucguacugggaucacaggaaggagcaaugcacacugcgcugacuggggcgacagaaauccagacgucaggaacgacaacaaucuuugcgggacaccugaaauguagacuaaaaauggacaaacugacuuuaaaagggaugucauaugugaugugcacaggcucauuuaagcuagagaaggaaguggcugagacccagcauggaacuguuuuagugcagguuaaauacgaaggaacagaugcaccaugcaagauccccuuuuugacccaagaugagaaaggagugacccagaaugggagauugauaacagccaauccuauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggccauccugggagacaccgcaugggacuucggcucuauaggaggauuguucacgucugugggaaaauugauacaccagguuuuuggaacugcauaugggguucuguucagcgguguuucuuggaccaugaaaauaggaauagggauucugcugacaugguugggauuaaauucaaggagcacgucacuuucaaugacgugcauugcaguuggcauggucacacuguaccuaggagucaugguucaagcggacucgggaugugugaucaacuggaagggcagagaacucaaauguggaaguggcauuuuugucacuaaugaaguccacacuuggacagagcaauauaaauuccaggcugacuccccaaaaagacugucagcagccauugggaaggcaugggaggaaggcguguguggaauucggucagccacgcgucuugagaacaucauguggaagcaaauaucaaaugaauugaacuacauccuacuugaaaaugacaugaaauucacagugguuguaggagacgcuaauggaauuuuggcccaaggaaaaaaaaugauuagaccacaacccauggaacacaaauacucauggaaaaguuggggaaaagccaaaaucauaggagcagacauacagaacaccaccuuuaucauugacggcccagauacuccagaaugccccgaugaccaaagagcauggaacauuugggaaguugaggacuauggguucggaauuuucacgacaaacauauggcugaaauugcgugacucccacacccaaaugugugaccaccggcuaaugucagcugccaucaaggacagcaaggcaguccaugcugauaugggguacuggauagaaagugaaaagaacgagaccuggaagcuagcgagagccuccuuuauagaagucaagacaugcaucuggccgaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguagaugaacauuguggauaucgagguccaucucucagaacuacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauuaggaauacuaugcguaucaauacugauugaagaagugaugagauccagauggaguagaaagaugcugaugacuggaacacuggcuguuuuccuccuucuuauaaugggacaacugacauggaaugaucugaucagguuaugcaucaugguuggagccaaugcuucagacaggauggggauggggacaacguaccuagccuugauggccacuuucaaaaugagaccaauguucgcuguugggcuauuauuucgcagacuaacauccagagaaguucuucuucucacgauuggauuaagccugguggcauccguggagcuaccaaauucuuuagaggagcuaggggauggacuugcaaugggcaucaugauguuaaaauuauugacugacuuccagccacaccaguuauggaccacccuauugucucuaacauuuaucagaacaucucuuucauuggauuaugcauggaagacaauggcuauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccaucaaugaaggaauuauggcuguuggaauagucagcauucuacuaaguucacuccucaaaaaugaugugccgcuagccggcccacuaauagcuggagguaugcuaauagcauguuaugucauauccggaagcucagcugauuuaucauuggaaaaagcggcugagguauccugggaagaagaagcagaacacuccggcaccucacacaacauauuaguggagguccaagaugauggaacuaugaaaauaaaagaugaagagagggaugacacacucaccauacuccucaaagcaacucugcuggcagccucaggaguguacccaaugucaauaccggcaacucuuuuugugugguauuuuuggcagaaaaagaaacagagaucaggaguguuaugggacacacccagcccuccggaaguggaaagggcaguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacauccggaucucccaucgugaacagagagggaaaaauaguaggucuuuauggaaauggaguggugacaacaaguggaaccuacgucagugccaucgcucaagcuaaagcaucacaagaagggccucuaccagagauugaggacgagguguuuaagaaaagaaacuuaacaauaauggaccugcauccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaauuacaacaugauuaucauggaugaagcacauuuuacugauccagccagcauagcggccagaggguacaucucaacccgaguggguaugggugaagcagcugcgaucuucaugacagccacucccccaggaucgguggaggccuuuccacagagcaaugcaguuauccaagaugaggaaagagacauuccugagagaucauggaacucaggcuacgacuggaucacugauuuuccagguaaaacaguuugguuuguuccaagcaucaaaucaggaaaugacauugcuaacuguuuaagaaagaacggaaaacgggugauucaacugagcaggaaaaccuuugacacugaguaccagaaaacaaaaaacaaugacugggacuacguugucacaacagacauuuccgaaaugggagcaaauuuccgggccgacaggguaauagauccaaggcggugcuugaaaccgguaauacuaaaggaugguccagagcgcguuauucuagccggaccgaugccagugacuguggccagugccgcccagaggagaggaagaauuggaaggaaccaaaacaaagaaggugaucaguacauuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagacggagaguacagacugcggggagaagcaaggaaaacguucguggagcucaugagaagaggagaucuaccaguuuggcuauccuacaaaguugccucagaagguuuccaauacuccgacagaagauggugcuuugauggggaaaggaauaaccagguguuggaggagaacauggacguggagaucuggacaaaggaaggagaaagaaagaaauugcgaccccgcugguuggaugcuagaacauacucugacccacuggcccugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauuccgaacaaggaggaaaagccuacagacaugcuauggaagaacuaccagacaccauagaaacauugaugcuccuagcuuugauagcugugcugacugguggagugacgcuguucuuccuaucaggaaaaggucuagggaaaacauccauuggccuacucugugugauggccucaagcgcacuguuauggauggccaguguggagccccauuggauagcggccuccaucauauuagaguucuuucugauggugcugcucauuccagagccagacagacagcgcacuccacaggacaaccaguuagcauauguggugauagguuuguuauucaugauacugacaguggcagcuaaugagaugggauugcuggaaaccacaaagaaagaccuagggauuggccauguagccgccgaaaaccaccaccaugccacaaugcuggacguagaccuacauccagcuucagccuggacccucuaugcaguagccacaacaguuaucacccccaugaugagacacacaauugaaaacacaacggcaaauauuucccugacagccaucgcaaaccaggcagcuauauugauggggcuugauaagggauggccaauaucgaagauggacauaggaguuccacuucucgccuuagggugcuauucccaagugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguuacaauagacuuggauccugugguuuaugaugcaaaauuugaaaaacagcuaggucaaauaauguuacugauacuuuguacaucacagauucucuugaugcggaccacaugggccuugugugaauccaucacacuggcuacuggacccuugaccacucuuugggagggaucuccaggaaaauucuggaacaccacgauagcaguguccauggcaaacaucuucaggggaaguuaucuagcaggagcaggucuggccuucucguugaugaaaucuuuaggaggagguaggagagguacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucauagaccucgguugugggagagguggcuggucauauuacugcgcugggcugaagaaagucacugaagugaagggauacacaaaaggaggaccuggacaugaggaacccaucccaauggcgaccuauggauggaacuugguaaagcuacacucugggaaagauguauucuucacaccaccugagaaaugugacacccuuuugugugacauuggugaguccucuccaaauccaacuauagaagaaggaagaacauuacguguucuaaagaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaacauaaaaaaugaacacaagucaacauggcauuaugaugaagacaauccauacaaaacaugggccuaucauggaucauaugaggucaagucaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaaagaggcacagcacaaauuauggaggugacagccaagugguuaugggguuuccuauccagaaacaaaaaacccagaaucugcacaagagaggaguucacaagaaaaguuaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggcuacgucaauuuuuaaacugaccuaccaaaauaagguggugagggugcaaagaccagcaaaaaguggaaccgugauggaugucauauccagacgugaccagagaggaaguggacaggucggaacuuauggcuuaaauacuuucaccaauauggagguccaauuaauaagacaaauggagucugaaggaauuuucucacccagcgaauuggaaacccccaaucuagcuaagagaguucuugacugguuggaaaaacauggcgccgaaaggcugaaaagaauggcaauuagcggagaugauuguguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaccagcugaucaugaaagauggaagagaaauaguggugccaugccgcaaccaagaugaacuugugggcagggcuagaguaucacaaggcgcuggauggagccugagagaaacugcuugccuaggcaagucauaugcacaaauguggcagcugauguacuuucacaggagagaccugagacuagcggcuaaugcuaucuguucagccgucccaguugauugggucccaaccagccgcacuaccuggucgauccaugcccaccaccaauggaugacaacagaagacauguuaucaguguggaauaggguuuggauagaggaaaacccauggauggaagacaaaacucauguauccaguugggaagaaguuccauaccuagggaaaagggaagaucaaugguguggauccuugauagguuugacagcaagggccaccugggccacuaacauacaaguagccauaaaccaagugagaaggcucaucgggaaugagaauuaucuagauuauaugacaucaaugaagagauucaagaaugagagugaucccgaaggggcacucugguaa

SEQ ID NO: 5326 - RNA, 9879 nt, Artificial Sequence
  derived and/or modified CDS sequence (wt) from DENV-1__FJ850071__SS-prME
uccgugaccaugcuccucaugcugcugcccacagcccuggcguuccauuugaccacacgagggggagagccacacaugauagucagcaagcaggaaagaggaaagucacucuuguuuaagaccucuguaggugucaacaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccgucgcacuggccccacacgugggacuuggucuagaaacaagaacugaaacguggauguccucugaaggcgccuggaaacaaauacaaaaaguggagacuugggcuuugcgacacccaggauucacagugauagcccuuuucuuggcacaugccauaggaacauccaucacucagaaagggaucauuuucauuuugcugaugcugguaacaccaucaauggccaugcgaugcgugggaauaggcaauagagacuucguugaaggacugucaggagcaacguggguggacgugguacuggagcauggaagcugcgucaccaccauggcaaaaaacaaaccaacauuggacauugaacucuugaaaacggaggucacgaacccugccguccugcgcaaacugugcauugaagcuaaaauaucaaacaccaccacugauucaagauguccaacacaaggagaagccacacugguggaagaacaagacgcgaacuuugugugucgacggacguucguggacagaggcugggguaauggcugcggacuauuuggaaaaggaagucuacugacgugugcuaaguucaagugugugacaaaacuagaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagacuuaccacugccuuggacuucgggagcuucaacaucccaagagacuuggaacagacaagauuugcuggucacauucaagacagcucaugcaaagaaacaggaaguagucguacugggaucacaggaaggagcaaugcacacugcgcugacuggggcgacagaaauccagacgucaggaacgacaacaaucuuugcgggacaccugaaauguagacuaaaaauggacaaacugacuuuaaaagggaugucauaugugaugugcacaggcucauuuaagcuagagaaggaaguggcugagacccagcauggaacuguuuuagugcagguuaaauacgaaggaacagaugcaccaugcaagauccccuuuuugacccaagaugagaaaggagugacccagaaugggagauugauaacagccaauccuauaguuacugacaaagaaaaaccagucaacauugagacagaaccaccuuuuggugagagcuacaucgugguaggggcaggugaaaaagcuuugaaacugagcugguucaagaaaggaagcagcauagggaaaauguucgaagcaaccgcccgaggagcacgaaggauggccauccugggagacaccgcaugggacuucggcucuauaggaggauuguucacgucugugggaaaauugauacaccagguuuuuggaacugcauaugggguucuguucagcgguguuucuuggaccaugaaaauaggaauagggauucugcugacaugguugggauuaaauucaaggagcacgucacuuucaaugacgugcauugcaguuggcauggucacacuguaccuaggagucaugguucaagcggacucgggaugugugaucaacuggaagggcagagaacucaaauguggaaguggcauuuuugucacuaaugaaguccacacuuggacagagcaauauaaauuccaggcugacuccccaaaaagacugucagcagccauugggaaggcaugggaggaaggcguguguggaauucgaucagccacgcgucuugagaacaucauguggaagcaaauaucaaaugaauugaacuacauccuacuugaaaaugacaugaaauucacagugguuguaggagacgcuaauggaauuuuggcccaaggaaaaaaaaugauuagaccacaacccauggaacacaaauacucauggaaaaguuggggaaaagccaaaaucauaggagcagacauacagaacaccaccuuuaucauugacggcccagauacuccagaaugccccgaugaccaaagagcauggaacauuugggaaguugaggacuauggguucggaauuuucacgacaaacauauggcugaaauugcgugacucccacacccaaaugugugaccaccggcuaaugucagcugccaucaaggacagcaaggcaguccaugcugauaugggguacuggauagaaagugaaaagaacgagaccuggaagcuagcgagagccuccuuuauagaagucaagacaugcaucuggccgaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguagaugaacauuguggauaucgagguccaucucucagaacuacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauuaggaauacuaugcguaucaauacugauugaagaagugaugagauccagauggaguagaaagaugcugaugacuggaacacuggcuguuuucuuccuucuuauaaugggacaacugacauggaaugaucugaucagguuaugcaucaugguuggagccaaugcuucagacaggauggggauggggacaacguaccuagccuugauggccacuuucaaaaugagaccaauguucgcuguugggcuauuauuucgcaaacuaacauccagagaaguucuucuucucacgauuggauuaagccugguggcauccguggagcuaccaaauucuuuagaggagcuaggggauggacuugcaaugggcaucaugauguuaaaauuauugacugacuuucagccacaccaguuauggaccacccuauugucucuaacauuuaucagaacaucucuuucauuggauuaugcauggaagacaauggcuauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccaucaaugaaggaauuauggcuguuggaauagucagcauucuacuaaguucacuccucaaaaaugaugugccgcuagccggcccacuaauagcuggaggcaugcuaauagcauguuaugucauauccggaagcucagcugauuuaucauuggaaaaagcggcugagguauccugggaagaagaagcagaacacuccggcaccucacacaacauauuaguggagguccaagaugauggaacuaugaaaauaaaagaugaagagagggaugacacacucaccauacuccucaaagcaacucugcuggcagucucaggaguguacccaaugucaauaccggcaacucuuuuugugugguauuuuuggcagaaaaagaaacagagaucaggaguguuaugggacacacccagcccuccggaaguggaaagggcaguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacauccggaucucccaucgugaacagagagggaaaaauaguaggucuuuauggaaauggaguggugacaacaaguggaaccuacgucagugccaucgcucaagcuaaagcaucacaagaagggccucuaccagagauugaggacgagguguuuaagaaaagaaacuuaacaauaauggaccugcauccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaauuacaacaugauuaucauggaugaagcacauuuuacugauccagccagcauagcggccagaggguacaucucaacccgaguggguaugggugaagcagcugcgaucuucaugacagccacucccccaggaucgguggaggccuuuccacagagcaaugcaguuauccaagaugaggaaagagacauuccugagagaucauggaacucaggcuacgacuggaucacugauuuuccagguaaaacaguuugguuuguuccaagcaucaaaucaggaaaugacauugcuaacuguuuaagaaagaacggaaaacgggugauucaacugagcaggaaaaccuuugacacugaguaccagaaaacaaaaaacaaugacugggacuacguugucacaacagacauuuccgaaaugggagcaaauuuccgggccgacaggguaauagauccaaggcggugcuugaaaccgguaauacuaaaggaugguccagagcgcguuauucuagccggaccgaugccagugacuguggccagugccgcccagaggagaggaagaauuggaaggaaccaaaacaaagaaggugaucaguacauuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccaguuuggcuauccuacaaaguugccucagaagguuuccaauacuccgacagaagauggugcuuugauggggaaaggaauaaccagguguuggaggagaacauggacguggagaucuggacaaaggaaggagaaagaaagaaauugcgaccccgcugguuggaugcuagaacauacucugacccacuggcccugcgcgaguuuaaagaguuugcagcaggaagaagaagugucucaggugaccuaauacuggaaauaggaaaacuuccacaacauuugacgcuaagagcccagaaugcucuggacaacuuggucauguugcacaauuccgaacaaggaggaaaagccuacagacaugcuauggaagaacuaccagacaccauagaaacauugaugcuccuagcuuugauagcugugcugacugguggagugacgcuguucuuccuaucaggaaaaggucuagggaaaacauccauuggccuacucugugugauggccucaagcgcacuguuauggauggccaguguggagccccauuggauagcggccuccaucauauuagaguucuuucugauggugcugcucauuccagagccagacagacagcgcacuccacaggacaaccaguuagcauauguggugauagguuuguuauucaugauacugacaguggcagcuaaugagaugggauugcuggaaaccacaaagaaagaccuggggauuggccauguagccgccgaaaaccaccaccaugccacaaugcuggacguagaccuacguccagcuucagccuggacccucuaugcaguagccacaacaguuaucacccccaugaugagacacacaauugaaaacacaacggcaaauauuucccugacagccauugcaaaccaggcagcuauauugauggggcuugauaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguuacaauagacuuggauccugugguuuaugaugcaaaauuugaaaaacagcuaggucaaauaauguuacugauacuuugcacaucacagauucucuugaugcggaccacaugggccuugugugaauccaucacacuggcuacuggacccuugaccacucuuugggagggaucuccaggaaaauucuggaacaccacgauagcaguguccauggcaaacaucuucaggggaaguuaucuagcaggagcaggucuggccuucucguugaugaaaucuuuaggaggagguaggagagguacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucauagaccucgguugugggagagguggcuggucauauuacugcgcugggcugaagaaagucacugaagugaaaggauacacaaaaggaggaccuggacaugaggaacccaucccaauggcgaccuauggauggaacuugguaaagcuacacucugggaaagauguauucuucacaccaccugagaaaugugacacccuuuugugugacauuggugaguccucuccaaauccaacuauagaagaaggaagaacauuacguguucuaaagaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguggccaaccuagauaucauuggccagaggauagagaacauaaaaaaugaacacaagucaacauggcauuaugaugaagacaauccauacaaaacaugggccuaucauggaucauaugaggucaagccaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaaagaggcacagcacaaauuauggaggugacagccaagugguuaugggguuuccuauccagaaacaaaaaacccagaaucugcacaagagaggaguucacaagaaaaguuaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggcuacgucaauuuuuaaacugaccuaccaaaauaagguggugagggugcaaagaccagcaaaaaguggaaccgugauggaugucauauccagacgugaccagagaggaaguggacaggucggaacuuauggcuuaaauacuuucaccaauauggagguccaauuaauaagacaaauggagucugaaggaauuuucucacccagcgaauuggaaacccccaaucuagcuaagagaguucuugacugguuggaaaaacauggcgccgaaaggcugaaaagaauggcaauuagcggagaugauuguguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaccagcugaucaugaaagauggaagagaaauaguggugccaugccgcaaccaagaugaacuugugggcagggcuagaguaucacaaggcgcuggauggagccugagagaaacugcuugccuaggcaagucauaugcacaaauguggcagcugauguacuuucacaggagagaccugagacuagcggcuaaugcuaucuguucagccgucccaguugauugggucccaaccagccgcacuaccuggucgauccaugcccaccaccaauggaugacaacagaagacauguuaucaguguggaauaggguuuggauagaggaaaacccauggauggaagacaaaacucauguauccaguugggaagaaguuccauaccuagggaaaagggaagaucaaugguguggauccuugauagguuugacagcaagggccaccugggccacuaacauacaaguagccauaaaccaagugagaaggcucaucgggaaugagaauuaucuagauuauaugacaucaaugaagagauucaagaaugagagugaucccgaaggggcacucugguaa

SEQ ID NO: 5327 - RNA, 9879 nt, Artificial Sequence
  derived and/or modified CDS sequence (wt) from DENV-1__FJ850073__SS-prME
uccgugaccaugcuccucaugcugcugcccacagcccuggcauuccacuugaccacacgagggggagagccacacaugauaguuaguaagcaggaaagaggaaagucacucuuguucaagaccucugcagguguuaauaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacucggucuagaaacaagaaccgaaacauggaugucuucugaaggcgccuggaaacaaauacaaaaaguggagacuugggcuuugagacauccaggauucacggugauagcccuuuuuuuagcacaugccauaggaacauccauuacucagaaagggaucauuuucauuuugcugaugcuggugacaccaucaauggccaugcgaugcgugggaauaggcaacagagacuucgucgaaggacugucaggagcaacguggguagacgugguauuggagcauggaagcugcgucaccaccauggcaaaaaauaaaccaacauuggacauugaacucuugaagacggaggucacgaacccugccgucuugcgcaaacugugcauugaagccaaaauaucaaacaccaccaccgauucaagauguccaacacaaggagaggcuacacugguggaagaacaagacgcgaacuuugugugucgccgaacguuuguggacagaggcugggguaauggcuguggauuauucggaaaaggaagccuauugacgugugccaaguuuaagugugugacaaaacuagaaggaaagauaguucaauaugaaaacuugaaauauucagugauaguuaccguccacacuggggaucagcaccaggugggaaacgagaccacagaacauggaacaauugcaaccauaacaccucaagcuccuacgucggaaauacagcugacugacuacggagcucucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaagaaggagcaaugcacaccgcguugacuggggcgacagaaauccagacgucaggaacgacaacaaucuuugcaggacaccugaaaugcagacuaaaaauggauaaacugacuuuaaaagggacgucauaugugaugugcacaggcucauuuaagcuagagaaggaaguggcugagacccagcauggaacuguucuagugcaggucaaauacgaaggaacagaugcgccaugcaagaucccuuuuucgacccaggaugagaaaggagugacccagaaugggagauugauaacagccaaucccauagucacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagauaccgcaugggacuucgguucuauaggaggaguguucacaucugugggaaaauugguacaccagguuuuuggaaccgcauaugguguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauuggaagggcaugggaggagggcguguguggaauucgaucagccacgcgucuugagaacaucauguggaagcaaauaucaaaugaauugaaccacauucuacuagaaaaugacauaaaauucacagugguuguaggaaaugcugauggaauuuuggcccaaggaaaaaaaaugauuaggccacaacccauggaacacaaauauucauggaaaagcuggggaaaagcuaaaaucauaggagcagacauacaaaauaccaccuucaucaucgacggcccagauacucuagaaugccccgaugaacaaagagcguggaacauuugggaaguugaggacuauggguuuggaauuuucacgacaaacauauggcugaaauugcgugacuccuacacccaaaugugugaccaccggcugaugucagcugccaucaaggacagcaaggcaguccaugcugacaugggguacuggauagaaagcgaaaagaacgaaaccuggaagcuggcgagagccucguucauagaagucaagacaugcaucuggccgaaaucccacacucuauggaguaauggaguuuuggaaagugaaaugauaaucccaaagauguauggaggaccaguaucucagcacaacuacagaccaggguauuucacacaaacagcagggccauggcaucuaggcaaguuggaauuggauuuugacuugugugaaggaaccacaguuguuguggaugaacauuguggaagucgagguccaucucucagaacuacaacagucacaggaaagauaauccaugaaugguguugcagauccugcacguuaccccccuuacguuucagaggagaagacggauguugguaugguauggaaaucagaccaguuaaggagaaggaggagaaccuaguuaggucaauggucucugcagggucaggagaaguggacaguuuuucauuaggaguacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaagauggggaugggaacaacguaccuagccuugauggcuacuuucaaaaugagaccaauguucgcuguugggcuauuauuucgcagacuaacauccagagaaguucuucuucucacgauuggauuaagccugguggcauccguggagcuaccaaauucuuuggaggagcuaggggauggacuugcaauggguaucaugauguuaaaauuauugacugaauuucagccacaucaguuauggaccaccuuacugucucugacauuuaucaaaacaacucuuucauuggauuacgcauggaagacaacggcuaugguacugucaaucguaucucucuuuccuuuaugccugucuacaaccucucaaaaaacaacauggcuuccggugcuguuaggaucuuuuggaugcaaaccauuaaccauguuucucauaacagaaaacgaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgaucuaucauuggagaaagcggcugagguauccugggaagaagaaguagaacacuccgguaccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcgguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccgggcaccuucaagacuccugaaggcgaaguuggagccauagcucuagauuuuaaacccggcacaucuggaucucccauugugaacagagagggaaaaauaguaggucuuuauggaaauggaguggugacaacaaguggaaccuacgucagugccauagcccaagcuaaagcaucacaggaagggccucuaccagagauugaggacgagguguucaagaaaagaaacuuaacaauaauggaccuccauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaaaagugagcacacaggaagggagauaguugaccucaugugccacgccacuuuuaccaugcgucucuuauccccagugagaguucccaauuacaacaugauuaucauggaugaagcacauuuuaccgauccagccaguauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaauucaggcuacgacuggaucacugauuuuccagguaaaacagucugguuuguuccaagcauuaaaucaggaaaugacauugccaacugcuuaagaaagaacggaaaacggguaauccaauugagcagaaaaaccuuugacacugaguaccagaaaacaaaaaacaaugacugggacuauguugucacaacagacauuuccgaaaugggggcaaauuuccgggcugacaggguaauagacccaaggcggugcuugaaaccgguaauacuaaaagaugguccagagcguguuauucuagccggaccgaugccagugacuguggccagugcugcccaaaggagaggaagaauuggaaggaaccagaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugacggagaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcauaauuccgaacaaggaggaaaagccuauagacaugccauggaggaacuaccagacaccauagaaacauugaugcuccuagcuuugauggcuguguugacugguggagugacgcuguucuuccuaucaggaaaaggucuagggaaaacguccauuggcuugcucugugugauggcuucaagcgcacuguuauggauggccaguguggagccccauuggauagcggccuccaucauacuagaguucuuuuugauggugcugcucauuccagagccagacagacagcgcacuccacaggacaaccagcuagcauauguggugauaggguuguuauucaugauacugacaguggcagccaaugagaugggauuauuggaaaccacaaagaaagaccuggggauuggccauguagccgccgaaaaccaccaacaugcuacaaugcuggacguagaccuacauccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggaccuaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugcgaaucuaucacacuggcuacuggaccccugaccacucuuugggagggaucuccaggaaaauucuggaauaccacgauagcaguguccauggcaaacaucuucaggggaaguuaucuggcaggagcaggucuggccuucucauuaaugaaaucuuuaggaggagguaggagagguacgggagcucaaggggaaacacuaggagagaaauggaaaagacaguuaaaccaacugagcaagucagaauucaacaccuacaaaaggagugggauuauggagguggacagaucugaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaaaaaagucacugaagugaagggauacacaaaaggaggaccuggacaugaggaacccaucccaauggcgaccuauggauggaaccuagugaagcugcacucuggaaaagauguauuuuuuaugccaccugagaaaugugacacccuucugugugauauuggugaguccucuccgaauccaacuauagaagaagguagaacguuacguguucuaaagaugguggaaccauggcucagaggcaaccaauucugcauaaaaauccuaaauccuuacaugccaagugugguagaaacucuggagcaaaugcaaagaaaacauggcgggaugcuagugcgaaacccacucucaagaaauuccacccaugaaauguacuggguuucaugugggacaggaaacauugugucggcagugaacaugacaucuagaauguugcugaaucgauucacaauggcucauaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugagguuaagccaucaggaucagccucaucuauggugaauggaguggugagauugcucacaaagccaugggauguuauccccauggucacacaaauagcuaugacugauaccacacccuuuggacaacagagaguguucaaagagaagguugacacgcgcacaccaagagcaaaacgaggcacagcacaaauuauggaagugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaggcccuugguuucaugaaugaagaucacugguuuaguagagagaacucacucaguggaguggaaggagaaggacugcacaaacuuggauacauacucagagacauaucaaagauuccggggggaaauauguaugcagaugauacagccggaugggacacaagaauaacagaggaugaucuucggaacgaggcuaaaaucacugacaucauggagccugaacaugcucuauuggcuacgucaauuuuuaagcugaccuaccaaaacaagguggugagggugcaaagaccagcaaaaaauggaaccgugauggauguuauauccagacgugaccagagaggaaguggacaggucggaacuuauggcuuaaauacuuucacuaauauggagguccaacuaauaagacaaauggagucugaaggaaucuuuuuuuccagcgaauuggaaagccccaaucuagcugaaagaguucuugacugguuggaaaaacauggcgccgaaaggcugaaaagaauggcaaucagcggagaugauuguguagugaaaccaauugaugacagauucgcaacagccuuaauagcucugaaugacaugggaaaaguaagaaaagacauaccgcagugggaaccuucaaaaggauggaaugauuggcagcaagugcccuucuguucacaccauuuccaccagcugaucaugaaggaugggagggaaauaguggugccaugccgcaaccaagacgaacuugugggcagggcuagaguaucacaaggcgccggauggagccugagagaaacugcuugccuaggcaagucauaugcacaaauguggcagcugauguacuuccacaggagagaccugagacuagcggcuaaugcuaucuguucagcugucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugggaauuaucuagauuacaugacaucaaugaagagauucaagaaugagagugaucccgaaggggcacucugguaa

SEQ ID NO: 5328 - RNA, 9879 nt, Artificial Sequence
  derived and/or modified CDS sequence (wt) from DENV-1__FJ850075__SS-prME
uccgugaccaugcuccucaugcugcugcccacagcccuggcguuucauuugaccacacgagggggagagccacacaugauagucagcaagcaggaaagaggaaagucacucuuguuuaagaccucuguaggugucaacaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccgucgcacuggccccacacgugggacuuggucuagaaacaagaacugaaacguggauguccucugaaggcgccuggaaacaaauacaaaaaguggagacuugggcuuugcgacacccaggauucacggugauagcccuuuucuuggcacaugccauaggaacauccaucacucagaaagggaucauuuucauuuugcugaugcugguaacaccaucaauggccaugcgaugcgugggaauaggcaauagagacuucguugaaggacugucaggagcaacguggguggacgugguacuggagcauggaagcugcgucaccaccauggcaaaaaacaaaccaacauuggacauugaacucuugaaaacggaggucacgaacccugccguccugcgcaaacugugcauugaagcuaaaauaucaaacaccaccaccgauucaagauguccaacacaaggagaagccacacugguggaagaacaagacgcgaacuuugugugucgacggacguucguggacagaggcugggguaauggcugcggacuauuuggaaaaggaagucuacugacgugugcuaaguucaagugugugacaaaacuagaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagacuuaccacugccuuggacuucgggagcuucaacaucccaagagacuuggaacagacaagauuugcuggucacauuuaagacagcucaugcaaagaaacaggaaguagucguacugggaucacaggaaggagcaaugcacacugcgcugacuggggcgacagaaauccagacgucaggaacgacaacaaucuuugcgggacaccugaaauguagacuaaaaauggacaaacugacuuuaaaagggaugucauaugugaugugcacaggcucauuuaagcuagagaaggaaguggcugagacccagcauggaacuguuuuagugcagguuaaauacgaaggaacagaugcaccaugcaagauccccuuuuugacccaagaugagaaaggagugacccagaaugggagauugauaacagccaauccuauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggccauccugggagacaccgcaugggacuucggcucuauaggaggauuguucacgucugugggaaaauugauacaccagguuuuuggaacugcauaugggguucuguucagcgguguuucuuggaccaugaaaauaggaauagggauucugcugacaugguugggauuaaauucaaggagcacgucacuuucaaugacgugcauugcaguuggcauggucacacuguaccuaggagucaugguucaagcggacucgggaugugugaucaacuggaagggcagagaacucaaauguggaaguggcauuuuugucacuaaugaaguccacacuuggacagagcaauauaaauuccaggcugacuccccaaaaagacugucagcagccauugggaaggcaugggaggaaggcguguguggaauucgaucagccacgcgucuugagaacaucauguggaagcaaauaucaaaugaauugaacuacauccuacuugaaaaugacaugaaauucacagugguuguaggagacgcuaauggaauuuuggcccaaggaaaaaaaaugauuagaccacaacccauggaacacaaauacucauggaaaaguuggggaaaagccaaaaucauaggagcagacauacagaacaccaccuuuaucauugacggcccagauacuccagaaugccccgaugaccaaagagcauggaacauuugggaaguugaggacuauggguucggaauuuucacgacaaacauauggcugaaauugcgugacucccacacccaaaugugugaccaccggcuaaugucagcugccaucaaggacagcaaggcaguccaugcugauaugggguacuggauagaaagugaaaagaacgagaccuggaagcuagcgagagccuccuuuauagaagucaagacaugcaucuggccgaaaucccacacucuauggaguaauggaguuuuagaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggauaucgagguccaucucucagaacuacaacaguuacaggaaagacaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauuaggaauacuaugcguaucaauacugauugaagaagugaugagauccagauggaguagaaagaugcugaugacuggaacacuggcuguuuuccuccuucuuauaaugggacaacugacauggaaugaucugaucagguuaugcaucaugguuggagccaaugcuucagacaggauggggauggggacaacguaccuagccuugauggccacuuucaaaaugagaccaauguucgcuguugggcuauuauuucgcagacuaacauccagagaaguucuucuucucacgauuggauuaagccugguggcauccguggagcuaccaaauucuuuagaggagcuaggggauggacuugcaaugggcaucaugauguuaaaauuauugacugacuuccagccacaccaguuauggaccacccuauugucucuaacauucaucagaacaucucuuucauuggauuaugcauggaagacaauggcuauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccaucaaugaaggaauuauggcuguuggaauagucagcauucuacuaaguucacuccucaaaaaugaugugccgcuagccggcccacuaauagcuggaggcaugcuaauagcauguuaugucauauccggaagcucagcugauuuaucauuggaaaaagcggcugagguauccugggaagaagaagcagaacacuccggcaccucacacaacauauuaguggagguccaagaugauggaacuaugaaaauaaaagaugaagagagggaugacacacucaccauacuccucaaagcaacucugcuggcagucucaggaguguacccaaugucaauaccggcaacucuuuuugugugguauuuuuggcagaaaaagaaacagagaucaggaguguuaugggacacacccagcccuccggaaguggaaagggcaguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacauccggaucucccaucgugaacagagagggaaaaauaguaggucuuuauggaaauggaguggugacaacaaguggaaccuacgucagugccaucgcucaagcuaaagcaucacaagaagggccucuaccagagauugaggacgagguguuuaagaaaagaaacuuaacaauaauggaccugcauccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaauuacaacaugauuaucauggaugaagcacauuuuacugauccagccagcauagcggccagaggguacaucucaacccgaguggguaugggugaagcagcugcgaucuucaugacagcuacucccccaggaucgguggaggccuuuccacagagcaaugcaguuauccaagaugaggaaagagacauuccugagagaucauggaacucaggcuacgacuggaucacugauuuuccagguaaaacaguuugguuuguuccaagcaucaaaucaggaaaugacauugcuaacuguuuaagaaagaacgggaaacgggugauucaacugagcaggaaaaccuuugacacugaguaccagaaaacaaaaaacaaugacugggauuacguugucacaacagacauuuccgaaaugggagcaaauuuccgggccgacaggguaauagauccaaggcggugcuugaaaccgguaauacuaaaggaugguccagagcgcguuauucuagccggaccgaugccagugacuguggccagugccgcccagaggagaggaagaauuggaaggaaccaaaacaaagaaggugaucaguacauuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccaguuuggcuauccuacaaaguugccucagaagguuuccaauacuccgacagaagauggugcuuugauggggaaaggaauaaccagguguuggaggagaacauggacguggagaucuggacaaaggaaggagaaagaaagaaauugcgaccccgcugguuggaugcuagaacauacucugacccacuggcccugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauuccgagcaaggaggaaaagccuacagacaugcuauggaagaacuaccagacaccauagaaacauugaugcuccuagcuuugauagcugugcugacugguggagugacgcuguucuuccuaucaggaaaaggucuagggaaaacauccauuggccuacucugugugauggccucaagcgcacuguuauggauggccaguguggagccccauuggauagcggccuccaucauauuagaguucuuucugauggugcugcucauuccagagccagacagacagcgcacuccacaggacaaccaguuagcauauguggugauagguuuguuauucaugauacugacaguggcagcuaaugagaugggauugcuggaaaccacaaagaaagaccuggggauuggccauguagccgccgaaaaccaccaccaugccacaaugcuggacguagaccuacguccagcuucagccuggacccucuaugcaguagccacgacaguuaucacccccaugaugagacacacaauugaaaacacaacggcaaauauuucccugacagccaucgcaaaccaggcagcuauauugauggggcuugauaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguuacaauagacuuggauccugugguuuaugaugcaaaauuugaaaaacagcuaggucaaauaauguuacugauacuuuguacaucacagauucucuugaugcggaccacaugggccuugugugaauccaucacacuggcuacuggacccuugaccacucuuugggagggaucuccaggaaaauucuggaacaccacgauagcaguguccauggcaaacaucuucaggggaaguuaucuagcaggagcaggucuggccuucucguugaugaaaucuuuaggaggagguaggagagguacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucauagaccucgguugugggagagguggcuggucauauuacugcgcugggcugaagaaagucacugaagugaagggauacacaaaaggaggaccuggacaugaggaacccaucccaauggcgaccuauggauggaacuugguaaagcuacacucugggaaagauguauucuucacaccaccugagaaaugugacacccuuuugugugacauuggugaguccucuccaaauccaacuauagaagaaggaagaacauuacguguucuaaagaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaacauaaaaaaugaacacaagucaacauggcauuaugaugaagacaauccauacaaaacaugggccuaucauggaucauaugaggucaagccaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaaagaggcacagcacaaauuauggaggugacagccaagugguuaugggguuuccuauccagaaacaaaaaacccagaaucugcacaagagaggaguucacaagaaaaguuaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggcuacgucaauuuuuaaacugaccuaccaaaauaagguggugagggugcaaagaccagcaaaaaguggaaccgugauggaugucauauccagacgugaccagagaggaaguggacaggucggaacuuauggcuuaaauacuuucaccaauauggagguccaauuaauaagacaaauggagucugaaggaauuuucucacccagcgaauuggaaacccccaaucuagcuaagagaguucuugacugguuggaaaaacauggcgucgaaaggcugaaaagaauggcaauuagcggagaugauuguguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaccagcugaucaugaaagauggaagagaaauaguggugccaugccgcaaccaagaugaacuugugggcagggcuagaguaucacaaggcgcuggauggagccugagagaaacugcuugccuaggcaagucauaugcacaaauguggcagcugauguacuuucacaggagagaccugagacuagcggcuaaugcuaucuguucagccgucccaguugauugggucccaaccagccgcacuaccuggucgauccaugcccaccaccaauggaugacaacagaagacauguuaucaguguggaauaggguuuggauagaggaaaacccauggauggaagacaaaacucauguauccaguugggaagaaguuccauaccuagggaaaagggaagaucaaugguguggauccuugauagguuugacagcaagggccaccugggccacuaacauacaaguagccauaaaccaagugagaaggcucaucgggaaugagaauuaucuagauuauaugacaucaaugaagagauucaagaaugagagugaucccgaaggggcacucugguaa

SEQ ID NO: 5329 - RNA, 9879 nt, Artificial Sequence
  derived and/or modified CDS sequence (wt) from DENV-1__FJ850077__SS-prME
uccgugaccaugcuccucaugcugcugcccacagcccuggcguuccauuugaccacacgagggggagagccacacaugauagucagcaagcaggaaagaggaaagucacucuuguuuaagaccucuguaggugucaacaugugcacucucauugcgauggauuugggagaguuaugugaggacacaaugaccuacaaaugcccccggaucaccgagguggaaccagaugacguugacugcuggugcaaugccacagacacaugggugaccuaugggacguguucucaaaccggcgaacaccgacgagacaaacguuccgucgcacuggccccacacgugggacuuggucuagaaacaagaacugaaacguggauguccucugaaggcgccuggaaacaaguacaaaaaguggagacuugggcuuugcgacacccaggauucacggugauagcccuuuucuuggcacaugccauaggaacauccaucacucagaaagggaucauuuucauuuugcugaugcugguaacaccaucaauggccaugcgaugcgugggaauaggcaauagagacuucguugaaggacugucaggagcaacguggguggaugugguacuggagcauggaagcugcgucaccaccauggcaaaaaacaaaccaacauuggacauugaacucuugaaaacggaggucacgaauccugccguccugcgcaaacugugcauugaagcuaaaauaucaaacaccaccacugauucaagauguccaacacaaggagaagccacacugguggaagaacaagacgcgaacuuugugugucgacggacguucguggacagaggcugggguaauggcugcggacuauuuggaaaaggaagucuacugacgugugcuaaguucaagugugugacaaaacuagaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccuuacauuggacugcucaccuagaacugggcuggacuuuaaugagauggugcuacugacaaugaaagaaaaaucauggcuuguccacaaacaaugguuucuagacuuaccacugccuuggacuucgggagcuucaacaucucaagagacuuggaacagacaagauuugcuggucacauucaagacagcucaugcaaagaaacaggaaguagucguacugggaucacaggaaggagcaaugcacacugcgcugacuggggcgacagaaauccagacgucaggaacgacaacaaucuuugcgggacaccugaaauguagacuaaaaauggacaaacugacuuuaaaagggaugucauaugugaugugcacaggcucauuuaagcuagagaaggaaguggcugagacccagcauggaacuguuuuagugcagguuaaauacgaaggaacagaugcaccaugcaagauccccuuuuugacccaagaugagaaaggagugacccagaaugggagauugauaacagccaauccuauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggccauccugggagacaccgcaugggacuucggcucuauaggaggauuguucacgucugugggaaaauugauacaccagguuuuuggaacugcauaugggguucuguucagcgguguuucuuggaccaugaaaauaggaauagggauucugcugacaugguugggauuaaauucaaggagcacgucacuuucaaugacgugcauugcaguuggcauggucacacuguaccuaggagucaugguucaagcggacucgggaugugugaucaacuggaagggcagagaacucaaauguggaaguggcauuuuugucacuaaugaaguccacacuuggacagagcaauauaaauuccaggcugacuccccaaaaagacugucagcagccauugggaaggcaugggaggaaggcguguguggaauucgaucagccacgcgucuugagaacauuauguggaagcaaauaucaaaugaauugaacuacauccuacuugaaaaugacaugaaauucacagugguuguaggagacgcuaauggaauuuugacccaaggaaaaaaaaugauuagaccacaacccauggaacacaaauacucauggaaaaguuggggaaaagccaaaaucauaggagcagacauacagaacaccaccuuuaucauugacggcccagauacuccagaaugccccgaugaccaaagagcauggaacaucugggaaguugaggacuauggguucggaauuuucacgacaaacauauggcugaaauugcgugacuccuacacccaaaugugugaccaccggcuaaugucagcugccaucaaggacagcaaggcaguccaugcugauaugggguacuggauagaaagugaaaagaacgagaccuggaagcuagcgagagccuccuuuauagaagucaagacaugcaucuggccgaaaucccacacucuauggaguaauggaguuuuggaaagugaaaugauaaucccaaagauauauggaggaccaacaucucagcacaacuacagaccaggguauuucacacaaacagcagggccauggcaccuaggcaaguuggaauuggauuuugacuugugugaagguaccacaguuguuguagaugaacauuguggauaucgagguccaucucucagaacuacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauuaggaauacuaugcguaucaauacugauugaagaagugaugagauccagauggaguagaaagaugcugaugacuggaacacuggcuguuuuccuccuucuuauaaugggacaacugacauggaaugaucugaucagguuaugcaucaugguuggagccaaugcuucagacaggauggggauggggacaacguaccuagccuugauggccacuuucaaaaugagaccaauguuugcuguugggcuauuauuucgcaaacuaacauccagagaaguucuucuucucacgauuggauuaagccugguggcauccguggagcuaccaaauucuuuagaggagcuaggggauggacuugcaaugggcaucaugauguuaaaauuauugacugacuuucagccacaccaguuauggaccacccuauugucucuaacauuuaucagaacaucucuuucauuggauuaugcauggaagacaauggcuauggcacugucaaucguaucucucuuuccuuugugucugucuacgaccucccaaaaaacaacauggcuuccggugcuguuaggaucuuuuggauguaaaccauuaaccauguuucucauaacagaaaacagaaucuggggaaggaaaagcuggcccaucaaugaaggaguuauggcuguuggaauagucagcauucuacuaaguucacuccucaaaaaugaugugccgcuagccggcccacuaauagcaggaggcaugcuaauagcauguuaugucauauccggaagcucagcugauuuaucauuggaaaaagcggcugagguauccugggaagaagaagcagaacacuccggcaccucacacaacauauuaguggagguccaagaugauggaacuaugaaaauaaaagaugaagagagggaugacacacucaccauacuccucaaagcaacucugcuggcagucucaggaguguacccaaugucaauaccggcaacucuuuuugugugguauuuuuggcagaaaaagaaacagagaucaggaguauuaugggacacacccagcccuccggaaguggaaagggcaguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacauccggaucucccaucgugaacagagagggaaagauaguaggucuuuauggaaauggaguggugacaacaaguggaaccuacgucagugccaucgcucaagcgaaagcaucacaagaagggccucuaccagagauugaggacgagguguucaagaaaagaaacuuaacaauaauggaccugcauccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaauuacaacaugauuaucauggaugaagcacauuuuacugauccagccagcauagcggccagaggguacaucucaacccgaguggguaugggugaagcagcugcgaucuucaugacagccacucccccaggaucgguggaggccuuuccacagagcaaugcaguuauccaagaugaggaaagagacauuccugagagaucauggaacucaggcuacgacuggaucacugauuuuccagguaaaacaguuugguucguuccaagcaucaaaucaggaaaugacauugcuaacuguuuaagaaagaacggaaaacgggugauucaacugagcaggaaaaccuuugacacugaguaccagaaaacaaaaaacaaugacugggacuacguugucacaacagacauuuccgaaaugggagcaaauuuccgggccgacaggguaauagauccaaggcggugcuugaaaccgguaauacuaaaggaugguccagagcgcguuauucuagccggaccgaugccagugacuguggcuagugccgcccagaggagaggaagaauuggaaggaaccaaaacaaagaaggugaucaguacauuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccaguuuggcuauccuacaaaguugccucagaagguuuccaauacuccgacagaagauggugcuuugauggggaaaggaauaaccagguguuggaggagaacauggacguggagaucuggacaaaggaaggagaaagaaagaaauugcgaccccgcugguuggaugcuagaacauacucugacccacuggcccugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauuccgaacaaggaggaaaagccuacagacaugcuauggaagaacuaccagacaccauagaaacauugaugcuccuagcuuugauagcugugcugacugguggagugacgcuguucuuccuaucaggaaaaggucuagggaaaacauccauuggccuacucugugugauggccucaagcgcacuguuauggauggccaguguggagccccauuggauagcggccuccaucauauuagaguucuuucugauggugcugcucauuccagagccagacagacagcgcacuccacaggacaaccaguuagcauauguggugauagguuuguuauucaugauacugacaguggcagcuaaugagaugggauugcuggaaaccacaaagaaagaccuggggauuggccauguagccgccgaaaaccaccaccaugccacaaugcuggacguagaccuacguccagcuucagccuggacccucuaugcaguagccacaacaguuaucacccccaugaugagacacacaauugaaaacacaacggcaaauauuuccuugacagccauugcaaaccaggcagcuauauugauggggcuugauaagggauggccaauaucgaagauggacauaggaguuccacuucucgccuuagggugcuauucccaggugaacccauugacacugacagcaacgguguugauguuaguggcucauuaugccauaauuggaccaggacugcaagcaaaggccacuagagaagcucaaaaaaggacagcggccggaauaaugaaaaauccaaccguagacgggauuguuacaauagacuuggauccugugguuuaugaugcaaaauuugaaaaacagcuaggucaaauaauguuacugauacuuuguacaucacagauucucuugaugcggaccacaugggccuugugugaauccaucacacuagcuacuggacccuugaccacucucugggagggaucuccaggaaaauucuggaacaccacgauagcaguguccauggcaaacaucuucaggggaaguuaucuagcaggagcaggucuggccuucucguugaugaaaucuuuaggaggagguaggagagguacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaagccagaagggaaagucauagaccucgguugugggagagguggcuggucauauuacugcgcugggcugaagaaagucacugaagugaaaggauacacaaaaggaggaccuggacaugaggaacccaucccaauggcgaccuauggauggaacuugguaaagcuacacucugggaaagauguauucuucacaccaccugagaaaugugacacccuuuugugugacauuggugaguccucuccaaauccaacuauagaagaaggaagaacauuacguguucuaaagaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauuuacaauggcucacaggaagccaacauaugaaagagacguggacuuaggcgcuggaacaagacauguggcaguggaaccagagguggccaaccuagauaucauuggccagaggauagagaacauaaaaaaugaacacaagucaacauggcauuaugaugaagacaauccauacaaaacaugggccuaucauggaucauaugaggucaagccaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaaagaggcacagcacaaauuauggaggugacagccaagugguuaugggguuucuuauccagaaacaaaaaacccagaaucugcacaagagaggaguucacaagaaaaguuaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggcuacgucaauuuuuaaacugaccuaccaaaauaagguggugagggugcaaagaccagcaaaaaguggaaccgugauggaugucauauccagacgugaccagagaggaaguggacaggucggaacuuauggcuuaaauacuuucaccaauauggagguccaauuaauaagacaaauggagucugaaggaauuuucucacccagcgaauuggaaacccccaaucuagcuaagagaguucuugacugguuggaaaaacauggcgccgaaaggcugaaaagaauggcaauuagcggagaugauuguguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaccagcugaucaugaaagauggaagagauauaguggugccaugccgcaaccaagaugaacuugugggcagggcuagaguaucacaaggcgcuggauggagccugagagaaacugcuugccuaggcaagucauaugcacaaauguggcagcugauguacuuucacaggagagaccugagacuagcggcuaaugcuaucuguucagccgucccaguugacugggucccaaccagccguacuaccuggucgauccaugcccaccaccaauggaugacaacagaagacauguuaucaguguggaauaggguuuggauagaggaaaacccauggauggaagacaaaacucauguauccaguugggaagaaguuccauaccuaggaaaaagggaagaucaaugguguggauccuugauagguuugacagcaagggccaccugggccacuaacauacaaguagccauaaaccaagugagaaggcucaucgggaaugagaauuaucuagauuauaugacaucaaugaagagauucaagaaugagagugaucccgaaggggcacucugguaa

SEQ ID NO: 5330 - RNA, 9879 nt, Artificial Sequence
  derived and/or modified CDS sequence (wt) from DENV-1__FJ850081__SS-prME
uccgugaccaugcuccucaugcugcugcccacagcccuggcguuccauuugaccacacgagggggagagccacacaugauagucagcaagcaggaaagaggaaagucacucuuguuuaagaccucuguaggugucaacaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccgucgcacuggccccacacgugggacuuggucuagaaacaagaacugaaacguggauguccucugaaggcgccuggaaacaaauacaaaaaguggagacuugggcuuugcgacacccaggauucacggugauagcccuuuucuuggcacaugccauaggaacauccaucacucagaaagggaucauuuucauuuugcugaugcugguaacaccaucaauggccaugcgaugcgugggaauaggcaauagagacuucguugaaggacugucaggagcaacguggguggacguggugcuggagcauggaagcugcgucaccaccauggcaaaaaacaaaccaacauuggacauugaacucuugaaaacggaggucacgaacccugccguccugcgcaaacugugcauugaagcuaaaauaucaaacaccaccaccgauucaagauguccaacacaaggagaagccacacugguggaagaacaagacgcgaacuuugugugucgacggacguucguggacagaggcugggguaauggcugcggacuauucggaaaaggaagucuacugacgugugcuaaguucaagugugugacaaaacuagaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagacuuaccacugccuuggacuucgggagcuucaacaucccaagagacuuggaacagacaagauuugcuggucacauucaagacagcucaugcaaagaaacaggaaguagucguacugggaucacaggaaggagcaaugcacacugcgcugacuggggcgacagaaauccagacgucaggaacgacaacaaucuuugcgggacaccugaaauguagacuaaaaauggacaaacugacuuuaaaagggaugucauaugugaugugcacaggcucauuuaagcuagagaaggaaguggcugagacccagcauggaacuguuuuagugcagguuaaauacgaaggaacagaugcaccaugcaagauccccuuuuugacccaagaugagaaaggagugacccagaaugggagauugauaacagccaauccuauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggccauccugggagacaccgcaugggacuucggcucuauaggaggauuguucacgucugugggaaaauugauacaccagguuuuuggaacugcguaugggguucuguucagugguguuucuuggaccaugaaaauaggaauagggauucugcugacaugguugggauuaaacucaaggagcacgucacuuucaaugacgugcauugcaguuggcauggucacacuguaccuaggagucaugguucaagcggacucgggaugugugaucaacuggaagggcagagaacucaaauguggaaguggcauuuuugucacuaaugaaguccacacuuggacagagcaauauaaauuccaggcugacuccccaaaaagacugucagcagccauugggaaggcaugggaggaaggcguguguggaauucgaucagccacgcgucuugagaacaucauguggaagcaaauaucaaaugaauugaacuacauccuacuugaaaaugacaugaaauucacagugguuguaggagacgcuaauggaauuuuggcccaaggaaaaaaaaugauuagaccacaacccauggaacacaaauacucauggaaaaguuggggaaaagccaaaaucauaggagcagacauacagaacaccaccuucaucauugacggcccagauacuccagaaugccccgaugaccaaagagcauggaacauuugggaaguugaggacuauggguucggaauuuucacgacaaacauauggcugaaauugcgugacucccacacccaaaugugugaccaccggcuaaugucggcugccaucaaggacagcaaggcaguccaugcugauaugggguacuggauagaaagugaaaagaacgagaccuggaagcuagcgagagccuccuuuauagaagucaagacaugcaucuggccgaaaucccacacccuauggaguaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguagaugaacauuguggauaucgagguccaucucucagaacuacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauuaggaauacuaugcguaucaauacugauugaagaagugaugagauccagauggaguagaaagaugcugaugacuggaacacuggcuguuuuccuccuucuuauaaugggacaacugacauggaaugaucugaucagguuaugcaucaugguuggagcuaaugcuucagacaggauggggauggggacaacguaccuagccuugauggccacuuucaaaaugagaccaauguucgcuguugggcuauuauuucgcagacuaacauccagagaaguucuucuucucacgauuggauuaagccugguggcauccguggagcuaccaaauucuuuagaggaacuaggggacggacuugcaaugggcaucaugauguuaaaauuauugacugacuuccagccacaccaguuauggaccacccuauugucucuaacauuuaucagaacaucucuuucauuggauuaugcauggaagacaauggcuauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccaucaaugaaggaaucauggcuguuggaauagucagcauucuacuaaguucacuccucaaaaaugaugugccgcuagccggcccacuaauagcuggaggcaugcuaauagcauguuaugucauauccggaagcucagcugauuuaucauuggaaaaagcggcugagguauccugggaagaagaagcagaacacuccggcaccucacacaacauauuaguggagguccaagaugauggaacuaugaaaauaaaagaugaagagagggaugacacacucaccauacuccucaaagcaacucugcuggcagucucaggaguguacccaaugucaauaccggcaacucuuuuugugugguauuuuuggcagaaaaagaaacagagaucaggaguguuaugggacacacccagcccuccggaaguggaaagggcaguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacauccggaucucccaucgugaacagagagggaaaaauagugggucuuuauggaaauggaguggugacaacaaguggaaccuacgucagugccaucgcucaagcuaaagcaucacaagaagggccucuaccagagauugaggacgagguguucaagaaaagaaacuuaacaauaauggaccugcauccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaauuacaacaugauuaucauggaugaagcacacuuuacugauccagccagcauagcggccagaggguacaucucaacccgaguggguaugggugaagcagcugcgaucuucaugacagccacucccccaggaucggcggaggccuuuccacagagcaaugcaguuauccaagaugaggaaagagacauuccugagagaucauggaacucaggcuacgacuggaucacugauuuuccagguaaaacaguuugguuuguuccaagcaucaaaucaggaaaugacauugcuaacuguuuaagaaagaacggaaaacgggugauucaacugagcaggaaaaccuuugacacugaguaccagaaaacaaaaaacaaugacugggauuacguugucacaacagacauuuccgaaaugggagcaaauuuccgggccgacaggguaauagauccaaggcggugcuugaaaccgguaauacuaaaggaugguccagagcgcguuauucuagccggaccgaugccagugacuguggccagugccgcccagaggagaggaagaauuggaaggaaccaaaacaaagaaggugaucaguacauuuacaugggacagcccuuaaacaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccaguuuggcuauccuacaaaguugccucagaagguuuccaauacuccgacagaagauggugcuuugauggggaaaggaauaaccagguguuggaggagaacauggacguggagaucuggacaaaggaaggagaaagaaagaaacugcgaccccgcugguuggaugcuagaacauacucugacccacuggcccugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauuccgaacaaggaggaaaagccuacagacaugcuauggaagaacuaccagacaccauagaaacauugaugcuccuagcuuugauagcugugcugacugguggagugacgcuguucuuccuaucaggaaaaggucuagggaaaacauccauuggccuacucugugugauggccucaagcgcacuguuauggauggccaguguggagccccauuggauagcggccuccaucauauuagaguucuuucugauggugcuacucauuccagagccagacagacagcgcacuccacaggacaaccaguuagcauauguggugauagguuugcuauucaugauacugacaguggcagcuaaugagaugggauugcuggaaaccacaaagaaagaccuggggauuggccauguagccgccgaaaaccaccaccaugccacaaugcuggacguagaccuacguccagcuucagccuggacccucuaugcaguagccacaacaguuaucacccccaugaugagacacacaauugaaaacacaacggcaaauauuucccugacagccaucgcaaaccaggcagcuauauugauggggcuugauaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguuacaauagacuuggauccugugguuuaugaugcaaaauuugaaaaacagcuaggucaaauaauguuacugauacuuuguacaucacagauucucuugaugcggaccacaugggccuugugugaauccaucacacuggcuacuggacccuugaccacucuuugggagggaucuccaggaaaauucuggaacaccacgauagcaguguccauggcaaacaucuucaggggaaguuaucuagcaggagcaggucuggccuucucguugaugaaaucuuuaggaggagguaggagagguacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucauagaccucgguugugggagagguggcuggucauauuacugcgcugggcugaagaaagucacugaagugaaaggauacacaaaaggaggaccuggacaugaggaacccaucccaauggcgaccuauggauggaacuugguaaagcuacacucugggaaagauguauucuucacaccaccugagaaaugugacacccuuuugugugacauuggugaguccucuccaaauccaacuauagaagaaggaagaacauuacguguucuaaagaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuauugaaccgauucacaauggcucacaggaagccaacauaugaaagagacguggacuuaggcgcuggaacaagacauguggcaguggaaccagagguagccaaccuagauaucauuggccagaggauagagaacauaaaaaaugaacacaagucaacauggcauuaugaugaagacaauccauacaaaacaugggccuaucauggaucauaugaggucaagccaucaggaucagccucauccauggugaauggcguggugagauugcucaccaaaccaugggauguuaucccuauggucacacaaauagcuaugacugauaccacacccuucggacaacagaggguguuuaaagagaaaguugacacgcgcacaccaagagcaaaaagaggcacagcacaaauuauggaggugacagccaagugguuaugggguuuccuauccagaaacaaaaaacccagaaucugcacaagagaggaguucacaagaaaaguuaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagagaaaaaauuaggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaaacugaccuaccaaaauaagguggugagggugcaaagaccagcaaaaaguggaaccgugauggaugucauauccagacgugaccagagaggaaguggacaggucggaacuuauggcuuaaauacuuucaccaauauggagguccaauuaauaagacaaauggagucugaaggaauuuucucacccagcgaauuggaaacccccaaucuagcuaagagaguucuugacugguuggaaaaacauggcgccgaaaggcugaaaagaauggcaauuagcggagaugauuguguggugaaaccaauugaugacagguucgcaacagccuuaacagcuuugaaugauaugggaaaaguaagaaaggacauaccgcagugggaaccuucaaaaggauggaaugacuggcagcaagucccuuucuguucacaccacuuccaccagcugaucaugaaagauggaagagaaauaguggugccaugccgcaaccaagaugaacuugugggcagggcuagaguaucacaaggcgcuggauggagccugagagaaacugcuugccuaggcaagucauaugcacaaauguggcagcugauguacuuucacaggagagaccuaagacuagcggcuaaugccaucuguucagccgucccaguugauugggucccaaccagccgcacuaccuggucgauccaugcccaccaccaauggaugacaacagaagacauguuaucaguguggaauaggguuuggauagaggaaaacccauggauggaagacaaaacucauguauccaguugggaagaaguuccauaccuagggaaaagggaagaucaaugguguggauccuugauagguuugacagcaagggccaccugggccacuaacauacaaguagccauaaaccaagugagaaggcucaucgggaaugagaauuaucuagauuauaugacaucaaugaagagauucaagaaugagagugaucccgaaggggcacucugguaa

SEQ ID NO: 5331 - RNA, 9879 nt, Artificial Sequence
  derived and/or modified CDS sequence (wt) from DENV-1__FJ850084__SS-prME
uccgugaccaugcuccucaugcugcugcccacagcccuggcguuccauuugaccacacgagggggagagccacacaugauagucagcaagcaggaaagaggaaagucacucuuguuuaagaccucugugggugucaacaugugcacucucauugcgauggauuugggagaguuaugugaggacacaaugaccuauaaaugcccccggaucaccgagguggaaccagaugacguugacugcugguguaaugccacagacacaugggugaccuaugggacguguucucaaaccggcgaacaccgacgagacaaacguuccgucgcacuggccccacacgugggacuuggucuagaaacaagaacugaaacguggauguccucugaaggcgccuggaaacaaauacaaaaaguggagacuugggcuuugcgacacccaggauucacggugauagcccuuuucuuggcacaugccauaggaacauccaucacucagaaagggaucauuuucauuuugcugaugcugguaacaccaucaauggccaugcgaugcgugggaauaggcaauagagacuucguugaaggacugucaggagcaacguggguggacgugguacuggagcauggaagcugcgucaccaccauggcaaaaaacaaaccaacauuggacauugaacucuugaaaacggaggucacgaauccugccguccugcgcaaacugugcauugaagcuaaaauaucaaacaccaccacugauucaagauguccaacacaaggagaagccacacugguggaagaacaagacgcgaacuuugugugucgacggacguucguggauagaggcugggguaauggcugcggacuauuuggaaaaggaagucuacugacgugugcuaaguucaagugugugacaaaacuagaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagacuuaccacugccuuggacuucgggagcuucaacaucucaagagacuuggaacagacaagauuugcuggucacauucaagacagcucaugcaaagaaacaggaaguagucguacugggaucacaggaaggagcaaugcacacugcgcugacuggggcgacagaaauccagacgucaggaacgacaacaaucuuugcgggacaccugaaauguagacuaaaaauggacaaacugacuuuaaaagggaugucauaugugaugugcacaggcucauuuaagcuagagaaggaaguggcugagacccagcauggaacuguuuuagugcagguuaaauacgaaggaacagaugcaccaugcaagauccccuuuuugacccaagaugagaaaggagugacccagaaugggagauugauaacagccaauccuauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggccauucugggagacaccgcaugggacuucggcucuauaggaggauuguucacgucugugggaaaauugauacaccagguuuuuggagcugcauaugggguucuguucagcgguguuucuuggaccaugaaaauaggaauagggauucugcugacaugguugggauuaaauucaaggagcacgucacuuucaaugacgugcauugcaguuggcauggucacacuguaccuaggagucaugguucaagcggacucgggaugugugaucaacuggaagggcagagaacucaaauguggaagcggcauuuuugucacuaaugaaguccacacuuggacagagcaauauaaauuccaggcugacuccccaaaaagacugucagcagccauugggaaggcaugggaggaaggcguguguggaauucgaucagccacgcgucuugagaacauuauguggaagcaaauaucaaaugaauugaacuacauccuacuugaaaaugacaugaaauucacagugguuguaggagacgcuaauggaauuuugacccaaggaaaaaaaaugauuagaccacaacccauggaacacaaauacucauggaaaaguuggggaaaagccaaaaucauaggagcagacauacagaacaccaccuuuaucauugacggcccagauacuccagaaugcccugaugaccaaagagcauggaauaucugggaaguugaggacuauggguucggaauuuucacgacaaacauauggcugaaauugcgugacuccuacacccaaaugugugaccaccggcuaaugucagcugccaucaaggacagcaaggcaguccaugcugauaugggguacuggauagaaagugaaaagaacgagaccuggaagcuagcgagagccuccuuuauagaagucaagacaugcaucuggccgaaaucccacacucuauggaguaauggaguuuuggaaagugaaaugauaaucccaaagauauauggaggaccaacaucucagcacaacuacagaccaggguauuucacacaaacagcagggccauggcaccuaggcaaguuggaauuggauuuugacuugugugaagguaccacaguuguuguagaugaacauuguggauaucgagguccaucucucagaacuacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucagcagaaguggacaguuuuucauuaggaauacuaugcguaucaauacugauugaagaagugaugagauccagauggaguagaaagaugcugaugacuggaacacuggcuguuuuccuccuucuuauaaugggacaacugacauggaaugauuugaucagguuaugcaucaugguuggagccaaugcuucagacaggauggggauggggacaacguaccuagccuugauggccacuuucaaaaugagaccaauguucgcuguugggcuauuauuucgcaaacuaacauccagagaaguucuucuucucacgauuggauuaagccugguggcauccguggagcuaccaaauucuuuagaggagcuaggggauggacuugcaaugggcaucaugauguuaaaauuauugacugacuuucagccacaccaguuauggaccacccuauugucucuaacauuuaucagaacaucucuuucauuggauuaugcauggaagacaauggccauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccaucaaugaaggaauuauggcuguuggaauagucagcauucuacuaaguucacuccucaaaaaugaugugccgcuagccggcccauuaauagcuggaggcaugcuaauagcauguuaugucauauccggaagcucagcugauuuaucauuggaaaaagcggcugagguguccugggaagaagaagcagaacacuccggcaccucacacaacauauuaguggagguccaagaugauggaacuaugaaaauaaaagaugaagagagggaugacacacucaccauacuccucaaagcaacucugcuggcagucucaggaguguacccaaugucaauaccggcaacucuuuuugugugguauuuuuggcagaaaaagaaacagagaucaggaguauuaugggacacacccagcccuccggaaguggaaagggcaguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacauccggaucucccaucgugaacagagagggaaagauaguaggucuuuauggaaauggaguggugacaacaaguggaaccuacgucagugccaucgcucaagcgaaagcaucacaagaagggccucuaccagagauugaggacgagguguucaagaaaagaaacuuaacaauaauggaccugcauccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaauuacaacaugauuaucauggaugaagcacauuuuacugauccagccagcauagcggccagaggguacaucucaacccgaguggguaugggugaagcagcugcgaucuucaugacagccacucccccaggaucgguggaggccuuuccacagagcaaugcaguuauccaagaugaggaaagagacauuccugagagaucauggaacucaggcuacgacuggaucacugauuuuccagguaaaacaguuugguucguuccaagcaucaaaucaggaaaugacauugcuaacuguuuaagaaagaacggaaaacgggugauucaacugagcaggaaaaccuuugacacugaguaccagaaaacaaaaaacaaugacugggacuacguugucacaacagacauuuccgaaaugggagcaaauuuccgggccgacaggguaauagauccaaggcggugcuugaaaccgguaauacuaaaggaugguccagagcgcguuauuuuagccggaccgaugccagugacuguggcuagugccgcccagaggagaggaagaauuggaaggaaccaaaacaaagaaggugaucaguacauuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccaguuuggcuauccuacaaaguugccucagaagguuuccaauacuccgacagaagauggugcuuugauggggaaaggaauaaccagguguuggaggagaacauggacguggagaucuggacaaaggaaggagaaagaaagaaauugcgaccccgcugguuggaugcuagaacauacucugacccacuggcccugcgcgaguucaaagaguuugcagcaggaagaagaagugucucaggugaccuaauauuggaaauaggaaaacuuccacaacauuugacgcuaagagcccagaaugcucuggacaacuuggucauguugcacaauuccgaacaaggaggaaaagccuacagacaugcuauggaagaacuaccagacaccauagaaacauugaugcuccuagcuuugauagcugugcugacugguggagugacgcuguucuuccuaucaggaaaaggccuagggaaaacauccauuggccuacucugugugauggccucaagcgcacuguuauggauggccaguguggagccccauuggauagcggccuccaucauauuagaguucuuucugaugguguugcucauuccagagccagacagacagcgcacuccacaggacaaccaguuagcauauguggugauagguuuguuauucaugauacugacaguggcagcuaaugagaugggauugcuggaaaccacaaagaaagaccuggggauuggccauguagccgccgaaaaccaccaccaugccacaaugcuggacguagaccuacguccagcuucagccuggacccucuaugcaguagccacaacaguuaucacccccaugaugagacacacaauugaaaacacaacggcaaauauuuccuugacagccauugcaaaccaggcagcuauauugauggggcuugauaagggauggccaauaucgaagauggacauaggaguuccacuucucgccuuagggugcuauucccaggugaacccauugacacugacagcgacgguguugauguuaguggcucauuaugccauaauuggaccaggacugcaagcaaaggccacuagagaagcucaaaaaaggacagcggccggaauaaugaaaaauccaaccguagacgggauuguuacaauagacuuggauccugugguuuaugaugcaaaauuugaaaaacagcuaggucaaauaauguuacugauacuuuguacaucacagauucucuugaugcggaccacaugggccuugugugaauccaucacacuagcuacuggacccuugaccacucucugggagggaucuccaggaaaauucuggaacaccacgauagcaguguccauggcaaacaucuucaggggaaguuaucuagcaggagcaggucuggccuucucguugaugaaaucuuuaggaggagguaggagagguacgggagcucaaggggaaacacugggagaaaaguggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucauagaccucgguugugggagagguggcuggucauauuacugcgcugggcugaagaaagucacugaagugaaaggauacacaaaaggaggaccuggacaugaggaacccaucccaauggcgaccuauggauggaacuugguaaagcuacacucugggaaagauguauucuucacaccaccugagaaaugugacacccuuuugugugacauuggugaguccucuccaaauccaacuauagaagaaggaagaacauuacguguucuaaagaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauuuacaauggcucacaggaagccaacauaugaaagagacguggacuuaggcgcuggaacaagacauguggcaguggaaccagagguggccaaccuagauaucauuggccagaggauagaaaacauaaaaaaugaacacaagucaacauggcauuaugaugaagacaauccauacaaaacaugggccuaucauggaucauaugaggucaagccaucaggaucagccucauccauggugaauggcguggugagauugcucaccaaaccaugggauguuauccccauggucacacaaauagcuaugacugauacuacacccuucggacaacagaggguguuuaaagagaaaguugacacgcgcacaccaagagcaaaaagaggcacagcacaaauuauggaggugacagccaagugguuaugggguuucuuauccagaaacaaaaaacccagaaucugcacaagagaggaguucacaagaaaaguuaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaaugaagaucacugguuuaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggcuacgucaauuuuuaaacugaccuaccaaaauaagguggugagggugcaaagaccagcaaaaaguggaaccgugauggaugucauauccagacgugaccagagaggaaguggacaggucggaacuuauggcuuaaauacuuucaccaauauggagguccaauuaauaagacaaauggagucugaaggaauuuucucacccagcgaauuggaaacccccaaucuagcuaagagaguucuugacugguuggaaaaacauggcgccgaaaggcugaaaagaauggcaauuagcggagaugauuguguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaccagcugaucaugaaagauggaagagauauaguggugccaugccgcaaccaagaugaacuugugggcagggcuagaguaucacaaggcgcuggauggagccugagagaaacugcuugccuaggcaagucauaugcacaaauguggcagcugauguacuuucacaggagagaccugagacuagcggcuaaugcuaucuguucagccgucccaguugacugggucccaaccagccguacuaccuggucgauccaugcccaccaccaauggaugacaacagaagacauguuaucaguguggaauaggguuuggauagaggaaaacccauggauggaagacaaaacucauguauccaguugggaagaaguuccauaccuaggaaaaagggaagaucaaugguguggauccuugauagguuugacagcaagggccaccugggccacuaacauacaaguagccauaaaccaagugagaaggcucaucgggaaugagaauuaucuagauuauaugacaucaaugaagagauucaagaaugagagugaucccgaaggggcacucugguaa

SEQ ID NO: 5332 - RNA, 9879 nt, Artificial Sequence
  derived and/or modified CDS sequence (wt) from DENV-1__FJ850087__SS-prME
uccgugaccaugcuccucaugcugcugcccacagcccuggcguuccauuugacuacacgagggggagagccacacaugauagucagcaagcaggaaagaggaaagucacucuuguuuaagaccucuguaggugucaacaugugcacucucauugcgauggauuugggagaguuaugugaggacacaaugaccuacaaaugcccccggaucacugaggcggaaccagaugauguugacugcuggugcaaugccacagacacaugggugaccuaugggacguguucucaaaccggcgaacaccgacgagacaaacguuccgucgcacuggccccacacgugggacuuggucuagaaacaagaacugaaacguggaugucaucugaaggcgccuggaaacaaauacaaaaaguggagacuugggcuuugcgacacccaggauucacggugauagcccuuuucuuggcacaugccauaggaacauccaucacccagaaagggaucaucuucauuuugcugaugcugguaacaccaucaauggccaugcgaugcgugggaauaggcaauagagacuucguugaaggacugucaggagcaacguggguggacgugguacuggagcauggaagcugcgucaccaccauggcaaaaaacaaaccaacauuggacauugaacucuugaaaacggaggucacgaacccugccguccugcgcaaacugugcauugaagcuaaaauaucaaacaccaccaccgauucaagauguccaacacaaggagaagccacacugguggaagaacaagacgcgaacuuugugugucgacggacguucguggacagaggcugggguaauggcugcggacuauuuggaaaaggaagucuacugacgugugcuaaguucaagugugugacaaaacuagaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagacuuaccacugccuuggacuucgggagcuucaacaucccaagagacuuggaacagacaagauuugcuggucacauucaagacagcucaugcaaagaaacaggaaguagucgugcugggaucacaggaaggagcaaugcacacugcgcugacuggggcgacagaaauccagacgucaggaacgacaacaauuuuugcgggacaccugaaauguagacuaaaaauggacaaacugacuuuaaaagggaugucauaugugaugugcacaggcucauuuaagcuagagaaggaaguggcugagacccagcauggaacuguuuuagugcagguuaaauacgaaggaacagaugcaccaugcaagaucccuuuuuugacccaagaugagaaaggagugacccagaaugggagauugauaacagcuaauccuauaguuacugauaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggccauccugggagacaccgcaugggacuucggcucuauaggaggauuguucacgucugugggaaaauugauacaccagguuuuuggaacugcauaugggguucuguucagcgguguuucuuggaccaugaaaauaggaauagggauucugcugacaugguugggauuaaauucaaggagcacgucacuuucaaugacgugcauugcaguuggcauggucacacuguaccuaggagucaugguucaagcggacucgggaugugugaucaacuggaagggcagagaacucaaauguggaaguggcaucuuugucacuaaugaaguccacacuuggacagagcaauauaaauuccaggcugacuccccaaaaagacugucagcagccauugggaaggcaugggaggaaggcguguguggaauucgaucagccacgcgucuugagaacaucauguggaagcaaauaucaaaugaauugaacuacauccuacuugaaaaugacaugaaauucacagugguuguaggagacguuaauggaauuuuggcccaagggaaaaaaaugauuagaccacaacccauggaacacaaauacucauggaaaaguuggggaaaagccaagaucauaggagcagacauacagaacaccaccuuuaucauugacggcccagauacuccagaaugccccgaugaccaaagagcauggaacauuugggaaguugaggacuacggguucggaauuuucacgacaaacauauggcugaaauugcgugacucccacacccaaaugugugaccaucggcuaaugucagcugccaucaaggacagcaaagcaguccaugcugauaugggguacuggauagaaagugaaaagaacgagaccuggaagcuagcgagagccuccuuuauagaagucaagacaugcaucuggccgaaaucccacacucuauggaguaauggaguuuuggaaagugaaaugguaaucccaaagauauauggaggaccaauaucccagcacaacuacagaccaggguauuucacacaaacagcagggccauggcaccuaggcaaguuggaauuggauuuugacuugugugaagguaccacaguuguuguagaugaacauuguggauaucgagguccaucucucagaaccacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauuaggaauacuaugcguaucaauacugauugaagaaguaaugagauccagauggaguagaaagaugcugaugacuggaacacugguuguuuuccuccuucucauaaugggacaacugacauggaaugaucugaucagguuaugcaucaugguuggagccaaugcuucagacaggauggggauggggacaacguaccuagccuugauggccacuuucaaaaugagaccaauguucgcuguugggcuauuauuucgcagacuaacauccagagaaguucuucuucucacgguuggauuaagccugguggcauccguggagcuaccaaauucuuuagaggagcuaggggauggacuugcaaugggcaucaugauguuaaaauuauugacugacuuccagccacaccaguuauggaccacccuauugucucuaacauuuaucagaacaucucuuucauuggauuaugcauggaagacaauggcuauggcacugucaaucguaucucucuuuccuuugugucugucuacgaccucccaaaaaacaacauggcuuccggugcuguuaggauccuuuggauguaaaccauuaaccauguuucucauaacagaaaacaaaaucuggggaaggaaaagcuggcccaucaaugaaggaauuauggcuguuggaauaguuagcauucuacuaaguucacuccucaaaaaugaugugccacuagccggcccacuaauagcuggaggcaugcuaauagcauguuaugucauaucuggaagcucagcugauuuaucauuggaaaaagcggcugagguauccugggaagaagaagcagaacacuccggcaccucacacaacauauuaguggagguccaagaugauggaacuaugaaaauaaaagaugaagagagggaugacacacucaccauacuccucaaagcaacucugcuggcagucucaggaguguacccaaugucaauaccggcaacucuuuuugugugguauuuuuggcagaaaaagaaacagagaucaggaguguuaugggacacacccagcccuccggaaguggaaagggcaguucuugaugauggcauuuauagaaucuugcaaagaggacuguuggguaggucccaaguaggagugggaguucuccaagacggcguguuccacacaauguggcacgucaccaggggagcuguccuuauguaccaagggaagaggcuggaaccaagcugggccagugucaaaaaagacuugauuucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacauccggaucucccaucgugaacagagagggaaaaauaguaggucuuuauggaaauggaguggugacaacaaguggaaccuacgucagugccaucgcucaagcuaaagcaacacaagaagggccucuaccagagauugaggacgagguguuuaagaaaagaaacuuaacaauaauggaccugcauccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaauuacaacaugauuaucauggaugaagcacacuuuacugauccagccagcauagcagccagaggguacaucucaacccgaguggguaugggugaagcagcugcgaucuucaugacagccacucccccaggaucgguggaggccuuuccacagagcaaugcaguuauccaagaugaggaaagagacauuccugagagaucauggaacucaggcuacgacuggaucacugauuuuccagguaaaacaguuugguuuguuccaagcaucaaaucaggaaaugacauugcuaacugucuaagaaagaacggaaaacgggugauucaacugagcaggaaaaccuuugacacugaguaccagaaaacaaaaaacaaugacugggacuacguugucacaacagacauuuccgaaaugggagcaaauuuccgggccgacaggguaauagauccaaggcggugcuugaaaccgguaauacuaaaggaagguccagagcgcguuauucuagccggaccgaugccagugacuguggccagugccgcccagaggagaggaagaauuggaaggaaccaaaacaaagaaggugaucaguacauuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccaguuuggcuauccuacaaaguugccucagaagguuuccaauacuccgacagaagauggugcuuugauggggaaaggaauaaccagguguuggaggagaacauggacguggagaucuggacaaaggaaggagaaagaaagaaauugcgaccccgcugguuggaugcuagaacauacucugacccacuggcccugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauuccgaacaaggaggaaaagccuacagacaugcuauggaagaacuaccagacaccauagaaacauugaugcuccuagcuuugauagcugugcugacugguggagugacgcuguucuuccuaucaggaaaaggucuagggaaaacauccauuggccuacucugugugauggccucaagcgcacuguuauggauggccaguguggagccccauuggauagcggccuccaucauauuagaguucuuucugauggugcugcucauuccagagccagacagacagcgcacuccacaggacaaccaguuagcauauguggugauagguuuguuauucaugauacugacaguggcagcuaaugagaugggauuguuggaaaccacaaagaaagaccuggggauuggccauguagccgucgaaaaccaccaccaugccacaaugcuggacguagaccuacguccagcuucagccuggacccucuaugcaguagccacaacaguuaucacccccaugaugagacacacaauugaaaauacaacggcaaauauuucccugacagccaucgcaaaccaggcugcuauauugauggggcuugauaagggauggccaauaucgaagauggacauaggaguuccacuucucgccuuagggugcuauucccaggugaacccauugacacuaacagcggcgguguugauguuaguggcucauuaugccauaauuggaccaggacugcaagcaaaggccacuagagaagcucaaaaaaggacagcggccggaauaaugaaaaauccaaccguagacgggauugucacaauagacuuggauccugugguuuaugaugcaaaauuugaaaaacagcuaggucaaauaauguuacugauacuuuguacaucacagauucucuugaugcggaccacaugggccuugugugaauccaucacacuggcuacuggacccuugaccacucuuugggagggaucuccaggaaaauucuggaacaccacgauagcaguguccauggcaaacaucuucaggggaaguuaucuagcaggagcaggucuggccuucucguugaugaaaucuuuaggaggagguaggagagguacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucauagaccucgguugugggagagguggcuggucauauuacugcgcugggcugaagaaagucacugaagugaagggauacacaaaaggaggaccuggacaugaggaacccaucccaauggcgaccuauggauggaacuugguaaagcuacacucugggaaagauguauucuucacaccaccugagaaaugugacacccuuuugugugacauuggugaguccucuccaaauccaacuauagaagaaggaagaacauuacguguucuaaagaugguggaaccauggcuuagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucagcagugaacaugacaucuagaauguuacugaaccgauucacaauggcucacaggaagccaacauaugaaagagacguggacuuaggcgcuggaacaagacauguggcaguggaaccagagguagccaaccuagauaucauuggccagaggauagagaacauaaaaaaugaacauaagucaacauggcauuaugaugaagacaauccauacaaaacaugggccuaucauggaucauaugaggucaaaccaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaaagaggcacagcacaaaucauggaggugacagccaagugguuaugggguuuccuauccagaaacaaaaaacccagaaucugcacaagagaggaguucacaagaaaaguuaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggccacgucaauuuuuaaacugaccuaccaaaauaagguggugagggugcaaagaccagcaaaaagugggaccgugauggaugucauauccagacgugaccagagaggaaguggacaggucggaacuuauggcuuaaauacuuucaccaauauggagguccaauuaauaagacaaauggagucugaaggaauuuucucacccagcgaauuggaaacccccaaucuagcuaagaaaguucuugacugguuggaaaaacauggcgcugaaaggcugaaaagaauggcaauuagcggagaugauuguguggugaaaccaauugaugacagguucgcaacagccuuaacagcuuugaaugauaugggaaaaguaagaaaagacauaccgcaaugggaaccuucaaaaggauggaaugacuggcagcaaguccccuucuguucacaccacuuccaccagcugaucaugaaagauggaagagaaauaguggugccaugccgcaaccaagaugaacuugugggcagggcuagaguaucacaaggcgcuggauggagccugagagaaacugcuugccuaggcaagucauaugcacaaauguggcagcugauguacuuucacaggagagaccugagacuagcggcuaaugcuaucuguucagccgucccaguugauugggucccaaccagccgcaccaccuggucgauccaugcccaccaccaauggaugacaacagaagacauguuaucaguguggaauaggguuuggauagaggaaaacccauggauggaagacaaaacucauguauccaguugggaagaaguuccauaccuagggaaaagggaagaucaaugguguggauccuugauagguuugacagcaagggccaccugggccacuaauauacaaguagccauaaaccaagugagaaggcucaucgggaaugagaauuaucuagauuacaugacaucaaugaagagauucaagaaugagagugaucccgaaggggcacucugguaa

SEQ ID NO: 5333 - RNA, 9879 nt, Artificial Sequence
  derived and/or modified CDS sequence (wt) from DENV-1__FJ850090__SS-prME
uccgugaccaugcuccucaugcugcugcccacagcccuggcguuccauuugaccacacgagggggagagccacacaugauagucagcaagcaggaaagaggaaagucacuccuguuuaagaccucuguaggugucaacaugugcacucucauugcgauggauuugggagaguuaugugaggacacaaugaccuacaaaugcccccggaucaccgagguggaaccagaugacguugacugcuggugcaaugccacagacacaugggugaccuaugggacguguucucaaaccggcgaacaccgacgagacaaacguuccgucgcacuggccccacacgugggacuuggucuagaaacaagaacugaaacguggauguccucugaaggcgccuggaaacaaauacaaaaaguggagacuugggcuuugcgacacccaggauucacggugauagcccuuuucuuggcacaugccauaggaacauccaucacucagaaagggaucauuuucauuuugcugaugcugguaacaccaucaauggccaugcgaugcgugggaauaggcaauagagacuucguugaaggacugucaggagcaacguggguggacgugguacuggagcauggaagcugcgucaccaccauggcaaaaaacaaaccaacauuggacauugaacucuugaaaacggaggucacgaauccugccguccugcgcaaacugugcauugaagcuaaaauaucaaacaccaccacugauucaagauguccaacacaaggagaagccacacugguggaagaacaagacgcgaacuuugugugucgacggacguucguggauagaggcugggguaauggcugcggacuauuuggaaaaggaagucuacugacgugugcuaaguucaagugugugacaaaacuagaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagauuuaccacugccuuggacuucgggagcuucaacaucucaagagacuuggaacagacaagauuugcuggucacauucaagacagcucaugcaaagaaacaggaaguagucguacugggaucacaggaaggagcaaugcacacugcgcugacuggggcgacagaaauccagacgucaggaacgacaacaaucuuugcgggacaccugaaauguagacuaaaaauggacaaacugacuuuaaaagggaugucauaugugaugugcacaggcucauuuaagcuagagaaggaaguggcugagacccagcauggaacuguuuuagugcagguuaaauacgaaggaacagaugcaccaugcaagauccccuuuuugacccaagaugagaaaggagugauccagaaugggagauugauaacagccaauccuauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggccauccugggagacaccgcaugggacuucggcucuauaggaggauuguucacgucugugggaaaauugauacaccagguuuuuggaacugcauaugggguucuguucagcgguguuucuuggaccaugaaaauaggaauagggauucugcugacauggcugggauuaaauucaaggagcacgucacuuucaaugacgugcauugcaguuggcauggucacacuguaccuaggagucaugguucaagcggacucgggaugugugaucaacuggaagggcagagaacucaaauguggaaguggcauuuuugucacuaaugaaguccacacuuggacagagcaauauaaauuccaggcugacuccccaaaaagacugucagcagccauugggaaggcaugggaggaaggcguguguggaauucgaucagccacgcgucuugagaacauuauguggaagcaaauaucaaaugaauugaacuacauccuacuugaaaaugacaugaaauucacagugguuguaggagacgcuaauggaauuuugacccaagggaaaaaaaugauuagaccacaacccauggaacacaaauacucauggaaaaguuggggaaaagccaaaaucauaggagcagacauacagaacaccaccuuuaucauugacggcccagauacuccagaaugccccgaugaccaaagagcauggaacaucugggaaguugaggacuauggguucggaauuuucacgacaaacauauggcugaaauugcgugacucccacacccaaaugugugaccaccggcuaaugucagcugccaucaaggacagcaaggcaguccaugcugauaugggguacuggauagaaagugaaaagaacgagaccuggaagcuagcgagagccuccuuuauagaagucaagacaugcaucuggccgaaaucccacacucuauggaguaauggaguuuuggaaagugaaaugauaaucccaaagauauauggaggaccaacaucucagcacaacuacagaccaggguauuucacacaaacagcagggccauggcaccuaggcaaguuggaauuggauuuugacuugugugaagguaccacaguuguuguagaugaacauuguggauaucgagguccaucucucagaacuacaacaguuacaggaaagauaauccaugaaugguguugcagauccugcacguuaccccccuuacgcuucagaggagaagacggauguugguauggcauggaaaucagaccaguuaaggagaaggaggagaacuuaguuaggucaauggucucugcagggucaggagaaguggacaguuuuucauuaggaauacuaugcguaucaauacugauugaagaagugaugagauccagauggaguagaaagaugcugaugacuggaacacuggcuguuuuccuccuucuuauaaugggacaacugacauggaaugaucugaucagguuaugcaucaugguuggagccaaugcuucagauaggauggggauggggacaacguaccuagccuugauggccacuuucaaaaugagaccaauguucgcuguugggcuauuauuucgcaaacuaacauccagagaaguucuucuucucacgauuggauuaagccugguggcauccguggagcuaccaaauucuuuagaggagcuaggggauggacuugcaaugggcaucaugauguuaaaauuauugacugacuuucagccacaccaguuauggaccacccuauugucucuaacauuuauuagaacaucucuuucauuggauuaugcauggaagacaauggcuauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccaucaaugaaggaauuauggcuguuggaauagucagcauucuacuaaguucacuccucaaaaaugaugugccguuagccggcccacuaauagcuggaggcaugcuaauagcauguuaugucauauccggaagcucagcugauuuaucauuggaaaaagcggcugagguauccugggaagaagaagcagaacacucuggcaccucacacaacauauuaguggagguccaagaugauggaaccaugaaaauaaaagaugaagagagggaugauacacucaccauacuccucaaagcaacucugcuggcagucucaggaguguacccaaugucaauaccggcaacucuuuuugugugguauuuuuggcagaaaaagaaacagagaucaggaguauuaugggacacacccagcccuccggaaguggaaagggcaguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacauccggaucucccaucgugaacagagagggaaagauaguaggucuuuauggaaauggaguggugacaacaaguggaaccuacguuagugccaucgcucaagcgaaagcaucacaagaagggccucuaccagagauugaggacgagguguucaagaaaagaaacuuaacaauaauggaccugcauccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuucaccaugcgucucuuaucuccagugagaguucccaauuacaacaugauuaucauggaugaagcacauuuuacugauccagccagcauagcggccagaggguacaucucaacccgaguggguaugggugaagcagcugcgaucuucaugacagccacucccccaggaucgguggaggccuuuccacagagcaaugcaguuauccaagaugaggaaagagacauuccugagagaucauggaacucaggcuacgacuggaucacugauuuuccagguaaaacaguuugguucguuccaagcaucaaaucaggaaaugacauugcuaacuguuuaagaaagaacggaaaacgggugauucaacugagcaggaaaaccuuugacacugaguaccaaaaaacaaaaaacaaugacugggacuacguugucacaacagacauuuccgaaaugggagcaaauuuccgggccgacaggguaauagauccaaggcggugcuugaaaccgguaauacuaaaggaugguccagagcgcguuauucuagccggaccgaugccagugacuguggcuagugccgcccagaggagaggaagaauuggaaggaaccaaaacaaagaaggugaucaguacauuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccaguuuggcuauccuauaaaguugccucagaagguuuccaauacuccgacagaagauggugcuuugauggggaaaggaauaaccagguguuggaggagaacauggacguggagauuuggacaaaggagggagaaagaaagaaauugcgaccccgcugguuggaugcuagaacauacucugacccacuggcccugcgcgaguuuaaagaguuugcagcaggaagaagaagugucucaggugaccuaauauuggaaauaggaaaacucccacaacauuugacgcuaagagcccagaaugcucuggacaacuuggucauguugcacaauuccgaacaaggaggaaaagccuacagacaugcuauggaagaacuaccagacaccauagaaacauugaugcuccuagcuuugauagcugugcugacugguggagugacgcuguucuuccuaucaggaaaaggucuagggaaaacauccauuggccuacucugugugauggccucaagcgcacuguuauggauggccaguguggagccccauuggauagcggccuccaucauauuagaguucuuucugauggugcugcucauuccagagccagacagacagcgcacuccacaggacaaccaguuagcauauguggugauagguuuguuauucaugauauugacaguggcagcuaaugagaugggauugcuggaaaccacaaagaaagaccuggggauuggccauguagccgccgaaaaccaccaccaugccacaaugcuggacguagaccuacguccagcuucagccuggacccucuaugcaguagccacaacaguuaucacccccaugaugagacacacaauugaaaacacaacggcaaauauuuccuugacagccauugcaaaccaggcagcuauauugauggggcuugauaagggauggccaauaucgaagauggacauaggaguuccacuucucgccuuagggugcuauucccaggugaacccauugacacugacagcgacgguguugauguuaguggcucauuaugccauaauuggaccaggacugcaagcaaaggccacuagagaagcucaaaaaaggacagcggccggaauaaugaaaaauccaaccguagacgggauuguuacaauagacuuggauccugugguuuaugaugcaaaauuugaaaaacagcuaggucaaauaauguuacugauacuuuguacaucacagauucucuugaugcggaccacaugggccuugugugaauccaucacacuagcuacuggacccuugaccacucucugggagggaucuccaggaaaauucuggaacaccacgauagcaguguccauggcaaacaucuucaggggaaguuaucuagcaggagcaggucuggccuucucguugaugaaaucuuuaggaggagguaggagagguacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagaggaaccucgugaaaccagaagggaaagucauagaccucgguugugggagaggcggcuggucauauuacugcgcuggguugaagaaagucacugaagugaaaggauacacaaaaggaggaccuggacaugaggaacccaucccaauggcgaccuauggauggaacuugguaaagcuacacucugggaaagauguauucuucacaccaccugagaaaugugacacccuuuugugugacauuggugaguccucuccaaauccaacuauagaagaaggaagaacauuacguguucuaaagaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauuuacaauggcucacaggaagccaacauaugaaagagacguggacuuaggcgcuggaacaagacauguggcaguggaaccagagguggccaaccuagauaucauuggccagaggauagagaacauaaaaaaugaacacaagucaacauggcauuaugaugaagacaauccauacaaaacaugggccuaucauggaucauaugaggucaagccaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaaagaggcacagcacaaauuauggaggugacagccaagugguuaugggauuucuuauccagaaacaaaaaacccagaaucugcacaagagaggaguucacaagaaaaguuagaucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauuaggagaguucggaaaagcaaaagggagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggcuacgucaauuuuuaaacugaccuaccaaaauaagguggugagggugcaaagaccagcaaaaaguggaaccgugauggaugucauauccagacgugaccagagaggaaguggacaggucggaacuuauggcuuaaacacuuucaccaauauggagguccaauuaauaagacaaauggagucugaaggaauuuucucacccagcgaauuggaaacccccaaucuagcuaagagaguucuugacugguuggaaaaacauggcgccgaaaggcugaaaagaauggcaauuagcggagaugauuguguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaccagcugaucaugaaagauggaagagauauaguggugccaugccgcaaccaagaugaacuugugggcagggcuagaguaucacaaggcgcuggauggagccugagagaaacugcuugccuaggcaagucauaugcacaaauguggcagcugauguacuuucacaggagagaccugagacuagcggcuaaugcuaucuguucagccgucccaguugacugggucccaaccagccguacuaccuggucgauccaugcccaccaccaauggaugacaacagaagacauguuaucaguguggaauaggguuuggauagaggaaaacccauggauggaggacaaaacucauguauccaguugggaagaaguuccauaccuaggaaaaagggaagaucaaugguguggauccuugauagguuugacagcaagggccaccugggccacuaacauacaaguagccauaaaccaagugagaaggcucaucgggaaugagaauuaucuagauuauaugacaucaaugaagagauucaagaaugagagugaucccgaaggggcacucugguaa

SEQ ID NO: 5334 - RNA, 9879 nt, Artificial Sequence
  derived and/or modified CDS sequence (wt) from DENV-1__FJ850093__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggauuacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacaaauccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauaguuaccguccacacuggggaccagcaucagguggggaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggacaaacugacuuuaaaggggaugucauaugugaugugcacaggcucauucaagcuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggagugugcggaauucgaucagccacgcgucuugagaacauuauguggaagcaaauaucaaaugaauugaaccacauuuuacuugaaaaugauaugaaauucacagugguuguaggagaugcuaacggaauuuuggcccaagggaaaaagaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaccuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucuuagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacaggaacacuggcuguuuuccuccuucuuauaaugggacaacugacauggaaugaucugauuagguuaugcaucaugguuggagcuaaugcuucagacaggauggggaugggaacaacgcaccuagccuugauggcuacuuucaaaaugagaccaauguucgcuguugggcuauuauuccgcagauuaacauccagagaaguucuucuccucacgauuggauuaagccugauggcauccauggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugauacugucuaucguaucucucuuuccuuuaugccuguccacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaggcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugauuucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguugaucuuggcucccacaagaguuguugccucugaaauggcagaggcacucaagggaaugccaauaagauaucagacaacagcagugaagagugaaaccacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucaccgacuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcggccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacauacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuagauccugugguuuaugaugcaaaauuugaaaaacagcuaggccaaauaauguuacugauacuuuguacaucacagauccucuugaugcggaccacaugggccuugugugaauccauuacacuggcuacuggaccccugaccacucucugggagggaucuccgggaaaauucuggaauaccacgauagcaguguccauggcaaacaucuucaggggaaguuaucuagcaggagcaggucuggcuuuuucauuaaugaaaucuuuaggaggagguaggagagguacgggggcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagagaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauucccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaagcccagaaucugcacaagagaggaguucacaagaaaaguuaggucaaacgcggcaauaggagcaguguucguugaugaaaaccaauggaacucggcaaaagaagcaguggaagacgaaagguuuugggaccucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaucaagaugaacuugugggcagggccagaguaucgcaaggcgccggauggagccugagagaaacugcuugccuaggcaagucauaugcacaaauguggcagcugauguacuuccacaggagagaccugagacuagcggcuaacgccaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugcgaaggcucaucgggaaugagaauuaucuagauuacaugacaucaaugaagagauucaagaaugagagugauccugaaggagcacucugguaa

SEQ ID NO: 5335 - RNA, 9879 nt, Artificial Sequence
  derived and/or modified CDS sequence (wt) from DENV-1__GU131863__SS-prME
uccgugaccaugcuccucaugcugcugcccacagcccuggccuuccauuugacuacacgagggggagagccacacaugauagucagcaagcaggaaagaggaaagucacucuuguuuaagaccucuguaggugucaacaugugcacucucauugcgauggauuugggagaguuaugugaggacacaaugaccuacaaaugcccccggaucacugaggcggaaccagaugauguugacugcuggugcaaugccacagacacaugggugaccuaugggacguguucucaaaccggcgaacaccgacgagacaaacguuccgucgcacuggccccacacgugggacuuggucuagaaacaagaacagaaacguggaugucaucugaaggcgccuggaaacaaauacaaaaaguggagacuugggcuuugcgacacccaggauucacggugauagcccuuuucuuggcacaugccauaggaacauccaucacccagaaagggaucauuuucauuuugcugaugcugguaacaccaucaauggccaugcgaugcgugggaauaggcaauagagacuucguugaaggacugucaggagcaacguggguggacgugguacuggagcauggaagcugcgucaccaccauggcaaaaaacaaaccaacauuggacauugaacucuugaaaacggaggucacgaacccugccguccugcgcaaacugugcauugaagcuaaaauaucaaacaccaccaccgauucaagauguccaacacaaggagaagcuacacugguggaagaacaagacgcgaacuuugugugucgacggacguucguggacagaggcugggguaauggcugcggacuauuuggaaaaggaagucuacugacgugugcuaaguucaagugugugacaaaacuagaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagacuuaccacugccuuggacuucgggagcuucaacaucccaagagacuuggaacagacaagauuugcuggucacauucaagacagcucaugcaaagaaacaggaaguagucgugcugggaucacaggaaggagcaaugcacacugcgcugacuggggcgacagaaauccagacgucaggaacgacaacaauuuuugcgggacaccugaaauguagacuaaaaauggacaaacugacuuuaaaagggaugucauaugugaugugcacaggcucauuuaagcuagagaaggaaguggcugagacccagcauggaacuguuuuagugcagguuaaauacgaaggaacagaugcaccaugcaagaucccuuuuuugacccaagaugagaaaggagugacccagaaugggagauugauaacagcuaauccuauaguuacugauaaagaaaaaccagucaacauugagacagaaccaccuuuuggugagagcuacaucgugguaggggcaggugaaaaagcuuugaaacuaagcugguucaagaaaggaagcagcauagggaaaauguuugaagcaaccgcccgaggagcacgaaggauggccauccugggagacacugcaugggacuucggcucuauaggaggauuguucacgucugugggaaaauugauacaccagguuuuuggaacugcauaugggguucuguucagcgguguuucuuggaccaugaaaauaggaauagggauucugcugacaugguugggauuaaauucaaggagcacgucacuuucaaugacgugcauugcaguuggcauggucacacuguaccuaggagucaugguucaagcggacucgggaugugugaucaacuggaagggcagagaacucaaauguggaaguggcaucuuugucaccaaugaaguccacacuuggacagagcaauauaaauuccaggcugacuccccaaaaagacugucagcagccauugggaaggcaugggaggaaggcguguguggaauucgaucagccacgcgucuugagaacaucauguggaagcaaauaucaaaugaauugaacuacauccuacuugaaaaugacaugaaauucacagugguuguaggagacauuaauggaauuuuggcccaaggaaaaaaaaugaucagaccacaacccauggaacacaaauacucauggaaaaguuggggaaaagccaagaucauaggagcagacauacagaacaccaccuuuaucauugacgguccagauacuccagaaugccccgaugaccaaagagcauggaacauuugggaaguugaggacuacggguucggaauuuucacgacaaacauauggcugaaauugcgugacucccacacccaaaugugugaccaucggcuaaugucagcugccaucaaggacagcaaagcaguccaugcugauaugggguacuggauagaaagugaaaagaacgagaccuggaagcuagcgagagccuccuuuauagaagucaagacaugcaucuggccgaaaucccacacucuauggaguaauggaguuuuggaaagugaaaugguaaucccaaagauauauggaggaccaauaucucagcacaacuacagaccaggguauuucacacaaacagcagggccauggcaccuaggcaaguuggaauuggauuuugacuugugugaagguaccacaguuguuguagaugaacauuguggauaucgaggcccaucucucagaacuacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauuaggaauacuaugcguaucaauacugauugaagaaguaaugagauccagauggaguagaaagaugcugaugacuggaacacuggcuguuuuccuccuucucauaaugggacaacugacauggaaugaucugaucagguuaugcaucaugguuggagccaaugcuucagacaggauggggauggggacaacguaccuagccuugauggccacuuucaaaaugagaccaauguucgcuguugggcuauuauuucgcagacuaacauccagagaaguucuucuucucacgguuggauuaagccugguggcauccguggagcugccaaauucuuuagaggagcuaggggauggacuugcaaugggcaucaugauguuaaaauuauugacugacuuccagccacaccaguuauggaccacccuauugucucuaacauuuaucagaacaucucuuucauuggauuaugcauggaagacaauggcuauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccaucaaugaaggaauuauggcuguuggaauagucagcauucuacuaaguucacuccucaaaaaugaugugccgcuagccggcccacuaauagcuggaggcaugcuaauagcauguuaugucauaucuggaagcucagcugauuuaucauuggaaaaagcggcugagguauccugggaagaagaagcagaacacuccggcaccucacacaacauauuaguggagguccaagaugauggaacuaugaaaauaaaagaugaagagagggaugauacacucaccauacuccucaaagcaacucugcuggcagucucaggaguguacccaaugucaauaccggcaacucuuuuugugugguauuuuuggcagaaaaagaaacagagaucaggaguguuaugggacacacccagcccuccggaaguggaaagggcaguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccaucgcucaagcuaaagcaacacaagaagggccucuaccagagauugaggacgagguguuuaagaaaagaaacuuaacaauaauggaccugcauccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaauuacaacaugauuaucauggaugaagcacacuuuacugauccagccagcauagcagccagaggguacaucucaacccgaguggguaugggugaagcagcugcgaucuucaugacagccacucccccaggaucgguggaggccuuuccacagagcaaugcaguuauccaagaugaggaaagagacauuccugagagaucauggaacucaggcuacgacuggaucacugauuuuccagguaaaacaguuugguuuguuccaagcaucaaaucaggaaaugacauugcuaacuguuuaagaaagaacggaaaacgggugauucaacugagcaggaaaaccuuugacacugaguaccagaaaacaaaaaacaaugacugggacuacguugucacaacagacauuuccgaaaugggagcaaauuuccgggccgacaggguaauagauccaaggcggugcuugaaaccgguaauacuaaaggaagguccagagcgcguuauucuagccggaccgaugccagugacuguggccagugccgcccagaggagaggaagaauuggaaggaaccaaaacaaagaaggugaucaguacauuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccagucuggcuauccuacaaaguugccucagaagguuuccaauacuccgacagaagauggugcuuugauggggaaaggaauaaccagguguuggaggagaacauggacguggagaucuggacaaaggaaggagaaagaaagaaauugcgaccccgcugguuggaugcuagaacauacucugacccacuggcccugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauuccgaacaaggaggaaaagccuacagacaugcuauggaagaacuaccagacaccauagaaacauugaugcuacuagcuuugauagcugugcugacugguggagugacgcuguucuuccuaucaggaaaaggucuagggaaaacauccauuggccuacucugugugauggccucaagcgcacuguuauggauggccaguguggagccccauuggauagcggccuccaucauauuagaguucuuucugauggugcugcucauuccagagccagacagacagcgcacuccacaggacaaccaguuagcauauguggugauagguuuguuauucaugauacugacaguggcagcuaaugagaugggauuguuggaaaccacaaagaaagaccuggggauuggccauguagccgucgaaaaccaccaccaugccacaaugcuggacguagaccuacguccagcuucagccuggacccucuaugcaguagccacaacaguuaucacccccaugaugagacacacaauugaaaauacaacggcaaauauuucccugacagccaucgcaaaccaggcugcuauauugauggggcuugauaagggauggccaauaucgaagauggauauaggaguuccacuucucgccuuagggugcuauucccaggugaacccauugacacuaacagcggcgguguugauguuaguggcucauuaugccauaauuggaccaggacugcaagcaaaggccacuagagaagcucaaaaaaggacagcggccggaauaaugaaaaauccaaccguagacgggauugucacaauagacuuggauccugugguuuaugaugcaaaauuugaaaaacagcuaggucaaauaauguuacugauacuuuguacaucacagauucucuugaugcggaccacaugggccuugugugaauccaucacacuggcuacuggacccuugaccacucuuugggagggaucuccaggaaaauucuggaacaccacgauagcaguguccauggcaaacaucuucaggggaaguuaucuagcaggagcaggucuggccuucucguugaugaaaucuuuaggaggagguaggagaggcacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucauagaccucgguugugggagaggugguuggucauauuacugcgcugggcugaagaaagucacugaagugaagggauacacaaaaggaggaccuggacaugaggaacccaucccaauggcgaccuauggauggaacuugguaaagcuacacucugggaaagauguauucuucacaccaccugagaaaugugacacccuuuugugugacauuggugaguccucuccaaauccaacuauagaagaaggaagaacacuacguguucuaaagaugguggaaccauggcuuagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaacauaaaaaaugaacauaagucaacauggcauuaugaugaagacaauccauacaaaacaugggccuaucauggaucauaugaggucaaaccaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaaagaggcacagcacaaaucauggaggugacagccaagugguuaugggguuuccuauccagaaacaaaaaacccagaaucugcacaagagaggaguucacaagaaaaguuaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggccacgucaauuuuuaaacugaccuaccaaaauaagguggugagggugcaaagaccagcaaaaagugggaccgugauggaugucauauccagacgugaccagagaggaaguggacaggucggaacuuauggcuuaaauacuuucaccaauauggagguccaauuaauaagacaaauggagucugaaggaauuuucucacccagcgaauuggaaacccccaaucuagcuaagaaaguucuugacuggcuggaaaaacauggcgcugaaaggcugaaaagaauggcaauuagcggagaugauuguguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaucagcugaucaugaaagauggaagagaaauaguggugccaugccgcaaccaagaugaacuugugggcagggcuagaguaucacaaggcgcuggauggagccugagagaaacugcuugccuaggcaagucauaugcacaaauguggcagcugauguacuuucacaggagagaccugagacuagcggcuaaugcuaucuguucagccgucccaguugauugggucccaaccagccgcaccaccuggucgauccaugcccaccaccaauggaugacaacagaagacauguuaucaguguggaauaggguuuggauagaggaaaacccauggauggaagacaaaacucauguauccaguugggaagaaguuccauaccuagggaaaagggaagaucaaugguguggauccuugauagguuugacagcaagggccaccugggccacuaauauacaaguagccauaaaccaagugagaaggcucaucgggaaugagaauuaucuagauuauaugacaucaaugaagagauucaagaaugagagugaucccgaaggggcacucugguaa

SEQ ID NO: 5336 - RNA, 9879 nt, Artificial Sequence
  derived and/or modified CDS sequence (wt) from DENV-1__GQ868559__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugcuauaggaacauccaucacucagaaagggaucauuuucaucuugcugaugcuggugacaccaucaauggccaugcgaugugugggaauaggcaacagagacuucguugaaggacugucaggagcaacguggguggacgugguauuggagcauggaagcugcgucaccaccauggcaaaaaauaaaccaacauuggacauugaacuccugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaagggcaugucauaugugaugugcacaggcucauuuaagcuagagaaggaaguggcugagacccagcacggaacuguucuagugcaggucaaauacgaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagaguuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacauuauguggaagcaaauaucaaaugaauugaaccacauucuacuugaaaaugacaugaaauucacagugguuguaggagaugcuaacggaauuuuggcccaagggaagaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcaggcuaacauccagagaaguucuucuccucacgauuggauuaagccugguggcauccguggagcuaccaaauucuuuggaggagcuaggggauggacuugcaauggguaucaugauguuaaaauuguugaccgaauuucagccacaccaguuauggaccaccuuacugucucugacauuugucaaaacaacucuuucauuggauuaugcauggaaaacaacggcuaugguacugucaaucguaucucucuuuccuuuaugccugucuacgaccucccaaaaaacaacauggcuuccggugcuguuaggaucuuuuggaugcaaaccauuaaccauguuucuuauaacagaaaauaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcagagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacaccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugcuauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggcugacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuucuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacuaucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagaggaagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucucgugcacagagagagggagcuucauaaacagggaaaaugugccacaugugucuacaacaugauggggaagagagagaaaaaauugggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagggacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaauaagguagugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccacagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggagcacucugguaa

SEQ ID NO: 5337 - RNA, 9879 nt, Artificial Sequence
  derived and/or modified CDS sequence (wt) from DENV-1__GQ868560__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugcuauaggaacauccaucacucagaaagggaucauuuucaucuugcugaugcuggugacaccaucaauggccaugcgaugugugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauuuaagcuagagaaggaaguggcugagacccagcacggaacuguucuagugcaggucaaauacgaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagaguuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaacggaauucuggcccaagggaagaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacucaaacagcagggccauggcaccuagguaaguuggaacuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaauuauggaccaccuuacugucucugacauuugucaaaacaacucuuucauuggacuaugcauggaaaacaacggcuaugguacugucaaucguaucucucuuuccuuuaugccugucuacgaccucccaaaaaacaacauggcuuccggugcuguuaggaucuuuuggaugcaaaccauuaaccauguuucuuauaacagaaaauaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccaguaucaaaaaggacuugaucucauauggaggagguuggagguuucaaggaucauggaacacgggagaagaagugcaggugauagcuguugaaccaggaaaaaaccccaaaaauguacagacaacaccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggcugacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaauccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagaggaagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguagugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccacagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuauauagauuacaugacaucaaugaagagauucaagaaugagagugaucccgaaggagcacucugguaa

SEQ ID NO: 5338 - RNA, 9879 nt, Artificial Sequence
  derived and/or modified CDS sequence (wt) from DENV-1__GQ868561__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcuuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuucgugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcuccuacgucggaaauacagcugaccgacuacggagcccucacauuggauugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaauuuucacgacaaacauauggcugaaguugcgugacuccuacacccaaaugugugaccaccggcuaaugucagcugccaucaaggacagcaaggcaguccaugcugacaugggguacuggauagaaagugaaaagaacgaaaccuggaagcuggcgagggccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucucauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucucugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguagcuagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaucagguguuggaagagaacauggacguggagaucuggacaaaggaaggagaaagaaagaaauugcgaccucgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcagccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaguccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaauucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaccaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaccuagcugagagaguucuugacugguuggaaaaacauggugccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacggcgagggccaccugggccaccaacauacaaguagccauaaaccaagugagaaggcucaucgggaaugagaauuaucuagauuacaugacaucaaugaagagauucaagaaugagagugaucccgaaggagcacucugguaa

SEQ ID NO: 5339 - RNA, 9879 nt, Artificial Sequence
  derived and/or modified CDS sequence (wt) from DENV-1__GU131948__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugcuacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggguucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguuuaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcuccuacgucggaaauacagcugaccgacuacggagcccucacauuggacugcucaccuagaacagggcuggacuuuaaugagauggugcuauuaacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacauugugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaacugaaccacauucuacuugaaaaugacaugaaauucacagugguuguaggagaugcuaacggaauuuuggcccaagggaaaaaaaugauuaggccacaacccauggaacacaaauacucauggaagagcuggggaaaagcuaaaaucauaggagcagacauacaaaauaccaccuucaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggacgaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggaaaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaauucuucuccucacgauuggauuaagccuaguggcauccguggagcuaccaaauucuuuggaggagcuaggggauggacuugcaauggguaucaugauguuaaaauuguugacugaauuucagccacaccaguuauggaccaccuuacuuucucugacauuugucaaaacaacucucucauuggauuaugcauggaaaacaacggcuaugguacuaucuaucguaucucucuuuccuuuaugccugucuacgaccucccaaaaaacaacauggcuuccgguguuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagccccccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaucuucaagacuccugaaggcgaaguuggagccauagcucuagauuucaaacccggcacaucuggaucucccauugugaacagagagggaaaaauagugggucuuuauggaaacggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaauuuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugauugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcucagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaucagguguuggaggagaacauggacguggagaucuggacaaaggaaggagaaagaaagaaauugcgaccucgcugguuggaugccagaacauacucugauccacuggcccugcgcgaguuuaaagaguuugcagcaggaagaagaaguaucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuaggaugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacggccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugacauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuggauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaaucauggaggugacagccaagugguuaugggguuuccuuuccagaaacaaaaaacccagaaucugcacaagagaggaguucacaagaaagguuaggucaaacgcggcaauaggagcaguguucguugaugagaaccaauggaacucagcaaaagaagcaguggaagacgaaagguuuugggaucucgugcacagagagagggagcuucauaaacagggaaaaugugccacgugugucuauaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacggaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaccuagcugagagaguucuugacugguuggaaaaacauggcgccgaaaggcugaaacgaauggcaaucagcggagaugauugcguggugaaaccaauugacgacagguuugcaacagccuugacagcucugaaugacaugggaaaaguaagaaaagacacaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagcuauaaaccaagugagaaggcucaucgggaaugagaauuaucuagauuauaugacaucaaugaagagauucaagaaugagagugaucccgaaggagcacucugguaa

SEQ ID NO: 5340 - RNA, 9879 nt, Artificial Sequence
  derived and/or modified CDS sequence (wt) from DENV-1__GQ868562__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggauuacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaacaaaccaacauuggacauugaacucuugaagacggaggucacgaauccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaacaugagaacuuaaaauauucagugauaguuaccguccacacuggggaccagcaucagguggggaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauucaagcuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggaguguguggaauucgaucagccacgcgucuugagaacaucauguggaagcaaauaucaaaugaauugaaccacauucuacuugaaaaugauaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuuuaucaucgacggcccagauaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacgcaccuagccuugauggcuacuuucaaaaugagaccaauguucgcuguugggcuauuauuccgcagauuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggccuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguuguugccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugacuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacacgcuauggaggaacuaccagacaccauagaaacauugaugcuucuagcuuugauagcuguguugacugguggagcgacgcuauucuuccuaucaggaaaagguuuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacauacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuagauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaauugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguagcaguggaaccagagguagccaaccuagauauuauuggccagaggauagagaauauaaaaaaugaacauaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauacuacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaucaagaugaacuugugggcagggccagaguaucgcaaggcgccggauggagccugagagaaacugcuugccuaggcaagucauaugcacaaauguggcagcugauguacuuccacaggagagaccugagacuagcggcuaacgccaucuguucagccgucccaguugauugggucccaaccagccgcacaaccuggucaauccaugcccaccaccaauggaugacaacagaagacauguuaucaguguggaacaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5341 - RNA, 9879 nt, Artificial Sequence
  derived and/or modified CDS sequence (wt) from DENV-1__GQ868563__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcauuggccccacacgugggacuuggucuagaaacaagaaccgaaacauggauguccucugaaggcgccuggaaacaaauacaaagaguggagaccugggcuuugagacacccaggauucacggugauagcccucuuuuuagcacaugcuauaggaacauccaucacucagaaagggaucauuuucaucuugcugaugcuggugacaccaucaauggccaugcgaugugugggaauaggcaacagagacuucguugaaggacugucaggagcaacguggguggacgugguauuggagcauggaagcugcgucaccaccauggcaaaaaauaaaccaacauuggacauugaacucuugaagacggagguuacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugcaaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcuccuacgucggaaauacagcugaccgacuacggagcccucacauuagacugcucaccuagaacaggucuggacuuuaacgagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaauugacuuuaaaggggaugucauaugugaugugcacaggcucauuuaagcuagagaaggaaguggcugagacccagcauggaacuguucuagugcaggucaaauacgaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcgugugcggaauucgaucagccacgcgucuugagaacaucauguggaagcaaauaucaaaugaauugaaccacauucuacuugaaaaugacaugaaauucacagugguuguaggagaugcuaacggaauuuuggcccaagggaaaaaaaugauuagaccacaacccauggaacacaaauacucauggaaaagcuggggaaaagcuaaaaucauaggagcagacauacaaaaugccaccuucaucaucgacggcccagauaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggccguuuuccuccuucuuauaaugggacaacugacauggaaugaucugacuagguuaugcaucaugguuggagcuaaugccucagacaggauggggaugggaacaacguaccuagccuugauggcuacuuucaaaaugagaccaauguucgcuguugggcuauuauuucgcagacugacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuugcugucucugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcaauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccaguguaaaaaaggacuugaucucauauggaggagguuggagguuucaaggauuauggaacacgggagaagaagugcaggugauagcuguugaaccaggaaaaaaccccaaaaauguacagacaacgccggguaccuucaagacuccugaaggcgaaguuggagccauagcucuagacuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagagucguugccucugaaauggcagaggcacucaagggaaugccaauaagauaucagacaacagcagucaagagugaacacacaggaagagagauaguugaccucaugugccacgcuacuuuuaccaugcgucucuuauccccagugagaguucccaauuacaacaugauuauuauggaugaagcacauuuuaccgauccagccagcauagcggccagaggauacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugauuuuccagguaaaacagucugguuuguuccaagcauuaaaucaggaaaugacauugccaacuguuuaagaaagaacggaaaacggguaauccaauugagcagaaaaacuuuugacacugaguaccagaaaacaaaaaacaaugacugggacuauguugucacaacagacauuuccgaaaugggagcaaauuuccgggccgacaggguaauagacccaaggcggugccugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuucgagccagagagagaaaagagugcagcaauagacggggaguacagacugcggggagaagcaaggaaaacguucguggagcucaugagaagaggagaucuaccaguuuggcuauccuacaaaguagccucagaagguuuccaguacucugacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuauucuuccuaucaggaaaaggucuagggaaaacaucuauuggcuugcucugugugacggccucaagcgcacuguuauggauggccaguguggagccccauuggauagcggccuccaucauacuagaguucuuuuugauggugcugcucauuccagagccagauagacagcgcacuccacaggacaaccagcuagcauauguggugauagguuuguuauucaugauacugacaguggcagccaaugagaugggauuauuggaaaccacaaagaaagaccuggggauuggcuaugcagccgccgaaaaccaccaacaugcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguaccacuucucgccuuagggugcuauucccagguaaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcugggccaaauaauguuacugauacuuuguacaucacagauucucuugaugcggaccacaugggccuugugugaauccaucacacuggcuacuggaccccugaccacucucugggagggaucuccaggaaaauucuggaacaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguacccaaccuagauauuauuggccagaggauagagaauauaaaaaaugaacacaagucaacauggcauuaugaugaggacaauccauacaaaacaugggccuaucacggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguugugggguuuccuuuccagaaacaagaaacccagaaucugcacaagagaggaguucacaagaaagguuaggucaaacgcggcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaaaagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucagcggaguggaaggagaaggacugcacaaacuuggauacauacucagagacauaucaaagauuccggggggaaauauguaugcagaugauacagccggaugggacacaagaauaacggaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaccuagcugagagaguucuugacuggcuggaaaaacauggcgccgaaaggcugaaacgaauggcaaucagcggagaugauugcguggugaagccaauugacgacagguucgcaacagccuuaacagcucugaaugacaugggaaaaguaagaaaagacauaccgcagugggagccuucaaaaggauggaaugauuggcagcaagugcccuucuguucacaccauuuccaccagcugaucaugaaggaugggagggaaauaguggugccaugccgcaaccaagaugaacuugugggcagggcuagagugucacaaggcgccggauggagccugagagaaacugcuugccuaggcaagucauaugcacaaauguggcagcugauguacuuccacaggagagaccugagacuagcggcuaacgcuaucuguucagccgucccaguugaaugggucccaaccagccgcacaaccuggucaauccaugcccaucaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggagcacucugguaa

SEQ ID NO: 5342 - RNA, 9879 nt, Artificial Sequence
  derived and/or modified CDS sequence (wt) from DENV-1__GQ868564__SS-prME
uccgugaccaugcuccucaugcugcugcccacagcccuggcguuccauuugaccacacgagggggagagccacacaugauaguuaguaagcaggaaagaggaaaggcacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugugugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcuccuacgucggaaauacagcugaccgacuacggagcccuuacauuggacugcucaccuagaacagggcuggacuuuaacgagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauuuaagcuagagaaggaaguggcugagacccagcauggaacuguucuagugcaggucaaauacgaaggaacagacgcgccaugcaagauccccuucucgacccaagaugagaaaggagugacucagaaugggagauugauaacagccaaccccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugguguucuguucagcgguguuucuuggaccaugaaaauaggaauagggauucuguugacaugguugggauuaaacucaaggagcacgucacuuucgaugacgugcauugcaguuggcauggucacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaacggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaauuuucacgacaaacauauggcugaaauugcgugacuccuauacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaaggcaccacaguuguuguagaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagagggaggagaaucuaguuagaucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugacuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucucugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcaauuggaauagucagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacacgaagcagaacacuccggcgccucacacaacauauuaguagagguccaagaugauggaacuaugaaaauaaaagaugaagagagggaugacacacucacuauacuccuuaaagcagcuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcauuuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccugguaccuucaagacuccugaaggcgaaguuggagccauagcucuagacuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaauuuuggcucccacaagagucguugccucugaaauggcagaggcacucaagggaaugccaauaagauaucagacaacagcagucaagagugaacacacaggaagagagauaguugaccucaugugccacgcuacuuuuaccaugcgucuccuauccccagugagaguucccaauuacaacaugaucauuauggaugaagcacauuuuaccgauccagccagcauagcggccagaggauacaucucaacccgaguggguaugggugaagcagcugcgaucuuuaugacagccacucccccaggaucaguggaggccuuuccacagagcaaugcaguuauccaagaugaggaaagagacauuccugagagaucauggaacucaggcuacgacuggauuacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugccugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucacuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacucugacagaagguggugcuuugauggggaaaggaacaaccagguguuggaggagaacauggacguggagaucuggacaaaggaaggagaaagaaagaaauugcgaccucgcugguuggaugccagaacauauucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuauagacaugcuauggaggaacuaccagacaccauagaaacauugaugcuucuagcuuugauagcuguguugacugguggagugacgcuauucuuccuaucaggaaaaggucuagggaaaacaucuauuggcuugcucugugugacggccucaagcgcauuguuauggauggccaguguggagccccauuggauagcggccuccaucauacuagaguucuuuuugauggugcugcucauuccagagccagauagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacuacaagcaaaggccacuagagaagcucaaaaaaggacagcggccggaauaaugaaaaauccaaccguagacgggauuguugcaauagacuuggauccuguggucuaugaugcaaaauuugagaaacagcugggccaaauaauguuauugauacuuuguacaucacagauucucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcuggucuggcuuuuucauuaaugaagucuuuaggaggagguaggagagguacgggagcucaaggggaaacacuaggagagaaauggaaaagacaguuaaaccaacugagcaagucagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacauuacguguucuaaaaaugguggaaccauggcucagaggaaaccaauucugcauaaaaauccuaaauccuuacaugccaagugugguagaaacccuggagcaaaugcaaagaaaacauggagggaugcuagugcgaaacccacucucaagaaauucuacccaugaaauguauuggguuucauguggaacaggaaacauugugucggcagugaacaugacaucuagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucuuaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguugugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucagcggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaccuagcugagagaguucuugacugguuggaaaaacauggcgccgaaaggcugaaacgaauggcaaucagcggagaugauugcguggugaagccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugaaugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggagcacuuugguaa

SEQ ID NO: 5343 - RNA, 9879 nt, Artificial Sequence
  derived and/or modified CDS sequence (wt) from DENV-1__GQ868565__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcauuggccccacacgugggacuuggucuagaaacaagaaccgaaacauggauguccucugaaggcgccuggaaacaaauacaaagaguggagaccugggcuuugagacacccaggauucacggugauagcccucuuuuuagcacaugcuauaggaacauccaucacucagaaagggaucauuuucaucuugcugaugcuggugacaccaucaauggccaugcgaugugugggaauaggcaacagagacuucguugaaggacugucaggagcaacguggguggacgugguauuggagcauggaagcugcgucaccaccauggcaaaaaauaaaccaacauuggacauugaacucuugaagacggagguuacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugcaaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcuccuacgucggaaauacagcugaccgacuacggagcccucacauuagacugcucaccuagaacaggucuggacuuuaacgagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauuuaagcuagagaaggaaguggcugagacccagcauggaacuguucuagugcaggucaaauacgaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcgugugcggaauucgaucagccacgcgucuugagaacaucauguggaagcaaauaucaaaugaauugaaccacauucuacuugaaaaugacaugaaauucacagugguuguaggagaugcuaacggaauuuuggcccaagggaaaaaaaugauuagaccacaacccauggaacacaaauacucauggaaaagcuggggaaaagcuaaaaucauaggagcagacauacaaaaugccaccuucaucaucgacggcccagauaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggccguuuuccuccuucuuauaaugggacaacugacauggaaugaucugacuagguuaugcaucaugguuggagcuaaugcuucagacaggauggggaugggaacaacguaccuagccuugauggcuacuuucaaaaugagaccaauguucgcuguugggcuauuauuucgcagacugacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuugcugucucugacauuugucaaaacaacucucucauuggauuaugcauggaaaacaacggcuaugguacugucuaucguaucucucuuuccuuuaugccuguccacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcaauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccaguguaaaaaaggacuugaucucauauggaggagguuggagguuucaaggauuauggaacacgggagaagaagugcaggugauagcuguugaaccaggaaaaaaccccaaaaauguacagacaacgccggguaccuucaagacuccugaaggcgaaguuggagccauagcucuagacuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagagucguugccucugaaauggcagaggcacucaagggaaugccaauaagauaucagacaacagcagucaagagugaacacacaggaagagagauaguugaccucaugugccaugcuacuuuuaccaugcgucucuuauccccagugagaguucccaauuacaacaugauuauuauggaugaagcacauuuuaccgauccagccagcauagcggccagaggauacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggagcaaauuuccgggccgacaggguaauagacccaaggcggugccugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuucgagccagagagagaaaagagugcagcaauagacggggaguacagacugcggggagaagcaaggaaaacguucguggagcucaugagaagaggagaucuaccaguuuggcuauccuacaaaguagccucagaagguuuccaguacucugacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacacuugacgcuaagagcccagaaugcucuggacaacuuggucauguugcacaauuccgaacaaggaggaaaagccuacagacaugcuauggaggaacuaccagacacuauagaaacauugaugcuucuagcuuugauagcuguguugacugguggagugacgcuauucuuccuaucaggaaaaggucuagggaaaacaucuauuggcuugcucugugugacggccucaagcgcacuguuauggauggccaguguggagccccauuggauagcggccuccaucauacuagaguucuuuuugauggugcugcucauuccagagccagauagacagcgcacuccacaggacaaccagcuagcauauguggugauagguuuguuauucaugauacugacaguggcagccaaugagaugggauuauuggaaaccacaaagaaagaccuggggauuggcuaugcagccgccgaaaaccaccaacaugcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguaccacuucucgccuuagggugcuauucccagguaaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcugggccaaauaauguuacugauacuuuguacaucacagauucucuugaugcggaccacaugggccuugugugaauccaucacacuggcuacuggaccccugaccacucucugggagggaucuccaggaaaauucuggaacaccacgauagcaguguccauggcaaacaucuucaggggaaguuaucuagcaggggcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcuggacugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugauacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucacggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcuaaacgaggcacaacacaaauuauggaggugacagccaagugguugugggguuuccuuuccagaaacaagaaacccagaaucugcacaagagaggaguucacaagaaagguuaggucaaacgcggcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucagcggaguggaaggagaaggacugcacaaacuuggauacauacucagagacauaucaaagauuccggggggaaauauguaugcggaugauacagccggaugggacacaagaauaacggaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaccuagcugagagaguucuugacugguuggaaaaacauggcgccgaaaggcugaaacgaauggcaaucagcggagaugauugcguggugaagccaauugacgacagguucgcaacagccuuaacagcucugaaugacaugggaaaaguaagaaaagacauaccgcagugggagccuucaaaaggauggaaugauuggcagcaagugcccuucuguucacaccauuuccaccagcugaucaugaaggaugggagggaaauaguggugccaugccgcaaccaagaugaacuugugggcagggcuagagugucacaaggcgccggauggagccugagagaaacugcuugccuaggcaagucauaugcacaaauguggcagcugauguacuuccacaggagagaccugagacuagcggcuaacgcuaucuguucagccgucccaguugaaugggucccaaccagccgcacaaccuggucaauccaugcccaucaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggagcacucugguaa

SEQ ID NO: 5344 - RNA, 9879 nt, Artificial Sequence
  derived and/or modified CDS sequence (wt) from DENV-1__GQ868568__SS-prME
uccgugaccaugcuccucaugcugcugcccacagcccuggcguuccauuugaccacacgaggaggagagccacacaugauaguuaguaagcaggaaagaggaaagucacucuuguuuaagaccucugcaggugucaauauguguacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacauguuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaggaacaggacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcuccuacgucggaaauacagcugaccgacuacggagcccucacauuggacugcucaccuagaacagggcuggacuuuaacgagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaauuuucgcaggacaccugaaaugcagacuaaaaauggauaaacugacuuuaaaggggaugucauaugugaugugcacaggcucauuuaagcuagagaaggaaguggcugagacccagcauggaacuguucuagugcaggucaaauacgaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggggacaccgcaugggacuucgguucuauaggaggaguguuuacaucugugggaaaauugguacaucagguuuuuggaaccgcauaugggguucuguucagcgguguuucuuggaucaugaaaauaggaauagggauucuguugacaugguugggauuaaauucaaggagcacgucacuuucgaugacgugcauugcaguuggcauggucacacuguaucuaggagucaugguucaagcggacucaggauguguaauuaacuggaagggcagagaacuuaaauguggaaguggcauuuuugucaccaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaacggaauuuuggcccaaggaaaaaaaaugauuaggccacaacccauggaacacaaauacucauggaaaagcuggggaaaagcuaaaaucauaggagcagacacacaaaauaccaccuucaucaucgacggcccagacaccccagaaugucccgauggccaaagagcauggaacauuugggaaguugaggacuacggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcugggucaggagaaguggacaguuuuucauuaggaauauuaugcguaucaauaaugauugaagaagugaugagauccagauggaguagaaagaugcugaugacuggaacacuggcuguuuuccuccuucuuauaaugggacaacugacauggaaugaucugacuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcugggggauggacuugcaauggguaucaugauguuaaaauuguugacugaauuucagccacaccaguuauggaccaccuuacugucucugacauuugucaaaacaacucucucauuggauuaugcauggaaaacaacggcuaugguacugucuaucguaucucucuucccuuuaugccugucuacgaccucccaaaaaacaacauggcuuccgguacuguuaggaucuuuuggaugcaaaccauuaaccauguuucuuauaacagaaaacaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgaucuaucauuggagaaggcggcugagguguccugggaacaagaagcagaacacuccggugccucacacaacauauuaguagagguucaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuacagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccagggaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaagugggaccuacgucagugccauugcccaagcuaaagcaucacaggaagggccucuaccagagauugaggacgagguguuuaagaagagaaacuuaacaauaauggaccugcacccaggaucaggaaaaacaagaagauaucuuccagccauaguccgugaggccauaaaaaggaaacugcguacguuaaucuuggcucccacaagagucgucgccucugaaauggcagaggcacucaagggaaugccaauaagauaucagacaacagcagucaaaagugaacacacaggaagggagauaguugaccucaugugccacgccacuuuuaccaugcgucucuuauccccagugagaguucccaacuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuauaugggacagccuuuaaauaaugaugaggaucaugcucauuggacagaagcaaaaaugcuccuugacaauauaaacacaccagaagggaucaucccagcccucuuugagccagagagagaaaagagugcagcaguagacggggaguauagacugcggggagaagcaaggaaaacguucguggagcucaugagaagaggagaucuaccagucuggcuauccuacaaaguagccucagaagguuuccaguacucugacagaagguggugcuuugauggggaaaggaacaaucagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauucugaacaaggaggaaaagccuacagacaugcuauggaggaacuaccagacaccauagaaacauugaugcuucuagcuuugauagcuguguugacugguggagugacgcuauucuuccuaucaggaaaaggucuagggaaaacaucuauuggcuugcucugugugacggccucaagcgcacuguuauggauggccaguguggagccccauuggauagcggccuccaucauacuagaguucuucuugauggugcugcucauuccagagccagauagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcagccggaauaaugaaaaauccaaccguagacgggauuguugcaauagacuuggauccugugguuuaugaugcaaaauuugaaaaacagcugggccaaauaauguuacugauacuuuguacgucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaauccuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucuaugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuggugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggaugucauccccauggucacacaaauagcuaugacugauaccacacccuuuggacaacagagaguguuuaaagagaaaguugacacgcgcacaccaagagcaaaacgaggcacaacacaaauuauggaggugacggccaagugguugugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucagcggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaaguugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggccaacgcuaucuguucagccgucccaguugaaugggucccaaccagccgcacaaccuggucaauccaugcccaccaccaauggaugacaacagaagacauguuaucaguguggaauaggguuuggauagaggaaaacccauggauggaggacaaaacucauguauccagcugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggagcacucugguaa

SEQ ID NO: 5345 - RNA, 9879 nt, Artificial Sequence
  derived and/or modified CDS sequence (wt) from DENV-1__GQ868569__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcauuggccccacacgugggacuuggucuagaaacaagaaccgaaacauggauguccucugaaggcgccuggaaacaaauacaaagaguggagaccugggcuuugagacacccaggauucacggugauagcccucuuuuuagcacaugcuauaggaacauccaucacucagaaagggaucauuuucaucuugcugaugcuggugacaccaucaauggccaugcgaugugugggaauaggcaacagagacuucguugaaggacugucaggagcaacguggguggacgugguauuggagcauggaagcugcgucaccaccauggcaaaaaauaaaccaacauuggacauugaacucuugaagacggagguugcgaaccccgccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugcaaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcuccuacgucggaaauacagcugaccgacuacggagcccucacauuagacugcucaccuagaacaggucuggacuuuaacgagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauuuaagcuagagaaggaaguggcugagacccagcauggaacuguucuagugcaggucaaauacgaaggaacagacgcgccaugcaagauccccuucucgacccaagaugagaaaggagugacccagaaugggagauugauaacagccaaucccauaguuacugacaaagaaaaaccaguuaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcgugugcggaauucgaucagccacgcgucuugagaacaucauguggaagcaaauaucaaaugaauugaaccacauucuacuugaaaaugacaugaaauucacagugguuguaggagaugcuaacggaauuuuggcccaaggaaaaaaaaugauuagaccacaacccauggaacacaaauacucauggaaaagcuggggaaaagcuaaaaucauaggagcagacauacaaaaugccaccuucaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaauggugcugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggccguuuuccuccuucuuauaaugggacaacugacauggaaugaucugacuagguuaugcaucaugguuggagcuaaugcuucagacaggauggggaugggaacaacguaccuagccuugauggcuacuuucaaaaugagaccaauguucgcuguugggcuauuauuucgcagacugacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuugcugucucugacauuugucaaaacaacucucucauuggauuaugcauggaagacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcaauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggauuguugggcaggucccaaguaggagugggagucuuccaagacggcguguuccacacaauguggcacgucaccaggggagcuguccuuauguaccaagggaagaggcuggaaccaagcugggccaguguaaaaaaggacuugaucucauauggaggagguuggagguuucaaggauuauggaacaugggagaagaagugcaggugauagcuguugaaccaggaaaaaaccccagaaauguacagacaacgccggguaccuucaagacuccugaaggcgaaguuggagccauagcucuagacuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacacgaagauaucuuccagccauaguccgugaggccauaaaaaggaaacugcguacguuaaucuuggcucccacaagagucguugccucugaaauggcagaggcacucaagggaaugccaauaagauaucagacaacagcagucaagagugaacacacaggaagagagauaguugaccucaugugccacgcuacuuuuaccaugcgucucuuauccccagugagaguucccaauuacaacaugauuauuauggaugaagcacauuuuaccgauccagccagcauagcggccagaggauacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggagcaaauuuccgggccgacaggguaauagacccaaggcggugccugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuucgagccagagagagaaaagagugcagcaauagacggggaguacagacugcggggagaagcaaggaaaacguucguggagcucaugagaagaggagaucuaccaguuuggcuauccuacaaaguagccucagaagguuuucaguacucugacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuauucuuccuaucaggaaaaggucuagggaaaacaucuauuggcuugcucugugugacggccucaagcgcacuguuauggauggccaguguggagccccauuggauagcggccuccaucauacuagaguucuuuuugauggugcugcucauuccagagccagauagacagcgcacuccacaggacaaccagcuagcauauguggugauagguuuguuauucaugauacugacaguggcagccaaugagaugggauuauuggaaaccacaaagaaagaccuggggauuggcuaugcagccgccgaaaaccaccaacaugcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccagguaaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcugggccaaauaauguuacugauacuuuguacaucacagauucucuuaaugcggaccacaugggccuugugugaauccaucacacuggcuacuggaccccugaccacucucugggagggaucuccaggaaaauucuggaacaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaaggaaaagucauagaccucgguuguggaagagguggcuggucauauuauugcgcugggcugaagaaaguuaccgaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucacggaucauaugaggucaagccaucaggaucagccucaucuauggugaauggaguggugagauugcucacaaaaccaugggauguuauccccauggucacacaaauagcuaugacugauaccacaccauuuggacaacagagaguguuuaaagagaaaguugacacgcgcacaccaagagcaaaacgaggcacaacacaaauuauggaggugacagccaagugguuguggggcuuccuuuccagaaacaagaaacccagaaucugcacaagagaggaguucacaagaaagguuaggucaaacgcggcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucagcggaguggaaggagaaggacugcacaaacuuggauacauacucagagacauaucaaagauuccggggggaaauauguaugcagaugauacagccggaugggacacaagaauaacggaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaccuagcugagagaguucuugacugguuggaaaaacauggcgccgaaaggcugaaacgaauggcaaucagcggagaugauugcguggugaagccaauugacgacagguucgcaacagccuuaacagcucugaaugacaugggaaaaguaagaaaagacauaccgcagugggagccuucaaaaggauggaaugauuggcagcaagugcccuucuguucacaccauuuccaccagcugaucaugaaggaugggagggaaauaguggugccaugccgcaaccaagaugaacuugugggcagggcuagagugucacaaggcgccggauggagccugagagaaacugcuugccuaggcaagucauaugcacaaauguggcagcugauguacuuccacaggagagaccugagacuagcggcuaacgcuaucuguucagccgucccaguugaaugggucccaaccagccgcacaaccuggucaauccaugcccaucaccaauggaugacaacagaagacaugcuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugaggaggcucaucgggaaugagaauuaucuagauuacaugacaucaaugaagagauucaagaaugagagugaucccgaaggagcacucugguaa

SEQ ID NO: 5346 - RNA, 9879 nt, Artificial Sequence
  derived and/or modified CDS sequence (wt) from DENV-1__GQ868570__SS-prME
uccgugaccaugcuccucaugcugcugcccacagcccuggcguuccauuugaccacacgagggggagagccacacaugauagucaguaagcaggaaagaggaaagucacucuuguucaagaccucugcaggugucaauaugugcacccucauugcgauggacuugggagaguugugugaggacacaaugaccuacaaaugcccccggaucacugaggcggaaccagaugacguugacugcuggugcaaugccacagauacaugggugaccuaugggacguguucucaaaccggcgaacaccgacgagacaaacguuccguggcacuggccccacacgugggacuuggucuagaaacaagaaccgaaacauggauguccucugaaggcgcauggaaacaaauacaaagaguggagaccugggcuuugagacacccaggauucacggugauagcccuuuuucuagcacaugcuauaggaacauccaucacucagaaagggaucauuuucauccugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaauugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagaucugcuggucacauucaagacagcucaugcaaagaaacaggaaguggucguacuaggaucacaggaaggagcaaugcacacugcguugacuggggcgacagaaauccagacgucaggaacgacaacaaucuucgcaggacaccugaaaugcagacuaaaaauggauaaacugacuuuaaaagggaugucauaugugaugugcacagguucauuuaagcuagagaaggaaguggcugagacccagcauggaacuguucuagugcaggucaaauacgaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccaaguuuuuggaaccgcauaugggguucuguucagcgguguuucuuggaccaugaaaguaggaauagggauucuguugacaugguugggauuaaauucaaggagcacgucacuuucgaugacgugcauugcaguuggcauggucacacuguaccuaggagucaugguucaagcggauuugggauguguaauuaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagucacgcgucuugagaacaucauguggaagcaaauaucaaaugaauugaaccacauucuacuugaaaaugacaugaaauucacagugguuguaggagaugcuaacggaauuuuggcccaagggaagaaaaugauuaggccacaacccauggagcacaaauacucauggaaaaguuggggaaaagcuaaaaucauaggagcagacacacaaaauaccaccuuuaucaucgacggcccagacaccccagaaugucccgacggccaaagagcauggaacaucugggaaguugaggacuauggguuuggaauuuucacgacaaacauauggcugaaauugcgugacuccuacacccaaaugugugaccaccggcuaaugucagcugccaucaaagacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcacuuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaucaguuauggaccaccuuacugucucugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauugaccauguuucuuauaacagaaaacaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacuuacuauacuccuuaaagcaacuuugcuggcagucucaggaguguacccaaugucaauaccagcaacucuuuuugugugguauuuuuggcagaaaaagaaacaaagaucaggaguguuaugggauacacccagcccuccggaaguggaaagagcaguucuugaugauggcaucuauagaaucuugcaaagaggacuguugggcaggucccaaguaggagugggagucuuccaagacggcguuuuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaacguacagacaacgccggguaccuucaagacuccugaaggcgaaguuggagccauagcucuagauuucaaacccggcacaucuggaucucccauugugaacagagaggggaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuaccgauuuuccagguaaaacagucugguuuguuccaagcauuaaaucaggaaaugacauugccaacuguuuaagaaagaacggaaaacggguaauccaauugagcaggaaaaccuuugacacugaguaccagaaaacaaaaaacaaugacugggauuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaagaaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugacuuaauauuggaaauagggaaacuuccacaacauuugacgcugagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuauucuuccuaucaggaaaaggucuagggaaaacaucuauuggcuugcucugcgugacggccucaagcgcacuguuauggauggccaguguggagccccauuggauagcggccuccaucauauuagaguucuuuuugauggugcugcucauuccagagccagacaaacagcgcacuccacaggacaaccagcuagcauauguggugauagguuuguuauucaugauacuggcaguggcagccaaugagaugggauuauuggaaaccacaaagaaagaccuggggauuggcuauguagccaccgaaaaccaccaacaugcuacaaugcuggacguagaccuacgcccagcuucagccuggacccucuaugcaguagccacaacaguuaucacucccaugaugagacacacaauugaaaauacaacggcaaauauuucccugacagccauugcaaaucaggcagcuauauugaugggacuugacaagggauggccaauaucgaagauggacauagggguuccacuucucgccuuagggugcuacucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuugcacaucacagauccucuugaugcggaccacaugggccuugugugaauccaucacacuggcuacuggaccccuaaccacucucugggagggaucuccaggaaaauucuggaauaccacgauagcaguguccauggcaaacaucuucagaggaaguuaucuagcaggagcaggucuggcuuuuucauuaaugaaauccuuaggaggagguaggagagguacgggagcucaaggggaaacacugggagagaaauggaaaagacaguuaaaccaacugagcaagucagaauucaacaucuacaaaaggagugggauuauggagguggacagauccgaagccaaagagggacugaaaagaggagaaacaaccaaacaugcagugucgagaggaacggccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguugcguguucuaaaaaugguggaaccauggcucagaggaaaccaauucugcauaaaaauccuaaauccuuacaugccaagugugguagaaacucuggagcaaaugcaaagaaaacacggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggcuuaucauggaucauaugaggucaagccaucaggaucagccucaucuauggugaauggaguggugagauugcucacaaaaccaugggaugucauccccauggucacacaaauagcuaugacugauaccacacccuuuggacagcagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcuauaggagcaguguucguugaugaaaaccaauggaauucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuacuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaacacuuucaccaauauggagguccaacuaauaagacaaauggagucugaaggaaucuuuuuacccagcgaauuggaaacccccaaccuagcugagagaguucuugacugguuggaaaaacauggcgcugaaaggcugaaacgaauggcaaucagcggagaugauugcguggugaaaccaauugacgacagguucgcagcagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugccugucuaggcaagucauaugcacaaauguggcagcugauguacuuccacaggagagaccugagacuagcggcuaacgcuaucuguucagccgucccaguugacugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugaaaauuaucuagauuacaugacaucaaugaagagauucaagaaugagagugaucccgaaggagcacucugguaa

SEQ ID NO: 5347 - RNA, 9879 nt, Artificial Sequence
  derived and/or modified CDS sequence (wt) from DENV-1__KJ189302__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcuuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuucgugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcuccuacgucggaaauacagcugaccgacuacggagcccucacauuggauugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaauuuucacgacaaacauauggcugaaguugcgugacuccuacacccaaaugugugaccaccggcuaaugucagcugccaucaaggacagcaaggcaguccaugcugacaugggguacuggauagaaagugaaaagaacgaaaccuggaagcuggcgagggccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucucauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucucugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguagcuagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaucagguguuggaagagaacauggacguggagaucuggacaaaggaaggagaaagaaagaaauugcgaccucgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcagccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaguccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaauucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaccuagcugagagaguucuugacugguuggaaaaacauggugccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacggcgagggccaccugggccaccaacauacaaguagccauaaaccaagugagaaggcucaucgggaaugagaauuaucuagauuacaugacaucaaugaagagauucaagaaugagagugaucccgaaggagcacucugguaa

SEQ ID NO: 5348 - RNA, 9879 nt, Artificial Sequence
  derived and/or modified CDS sequence (wt) from DENV-1__KJ189303__SS-prME
uccgugaccaugcuccucaugcugcugcccacagcccuggcguuccauuugaccacacgaggaggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacauguuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaggaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcuccuacgucggaaauacagcugaccgacuacggagcccucacauuggacugcucaccuagaacagggcuggacuuuaacgagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaauuuucgcaggacaccugaaaugcagacuaaaaauggauaaacugacuuuaaaggggaugucauaugugaugugcacaggcucauuuaagcuagagaaggaaguggcugagacccagcauggaacuguucuagugcaggucaaauacgaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggggacaccgcaugggacuucgguucuauaggaggaguguuuacaucugugggaaaauugguacaucagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaucuaggagucaugguucaagcggacucgggauguguaauuaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaacggaauuuuggcccaaggaaaaaaaaugauuaggccacaacccauggaacacaaauacucauggaaaagcuggggaaaagcuaaaaucauaggagcagacacacaaaauaccaccuucaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcugggucaggagaaguggacaguuuuucauuaggaauauuaugcguaucaauaaugauugaagaagugaugagauccagauggaguagaaagaugcugaugacuggaacacuggcuguuuuccuccuucuuauaaugggacaacugacauggaaugaucugacuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcugggggauggacuugcaauggguaucaugauguuaaaauuguugacugaauuucagccacaccaguuauggaccaccuuacugucucugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgaucuaucauuggagaaggcggcugagguguccugggaacaagaagcagaacacuccggugccucacacaacauauuaguagagguucaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuacagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaagugggaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagagucgucgccucugaaauggcagaggcacucaagggaaugccaauaagauaucagacaacagcagucaaaagugaacacacaggaagggagauaguugaccucaugugccacgccacuuuuaccaugcgucucuuauccccagugagaguucccaacuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuauaugggacagccuuuaaauaaugaugaggaucaugcucauuggacagaagcaaaaaugcuccuugacaauauaaacacaccagaagggaucaucccagcccucuuugagccagagagagaaaagagugcagcaguagacggggaguacagacugcggggagaagcaaggaaaacguucguggagcucaugagaagaggagaucuaccaguuuggcuauccuacaaaguagccucagaagguuuccaguacucugacagaagguggugcuuugauggggaaaggaacaaucagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauucugaacaaggaggaaaagccuacagacaugcuauggaggaacuaccagacaccauagaaacauugaugcuucuagcuuugauagcuguguugacugguggagugacgcuauucuuccuaucaggaaaaggucuagggaaaacaucuauuggcuugcucugugugacggccucaagcgcacuguuauggauggccaguguggagccccauuggauagcggccuccaucauacuagaguucuucuugauggugcugcucauuccagagccagauagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcagccggaauaaugaaaaauccaaccguagacgggauuguugcaauagacuuggauccugugguuuaugaugcaaaauuugaaaaacagcugggccaaauaauguuacugauacuuuguacgucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucuaugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacggccaagugguugugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucagcggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaaguugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugaaugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggagcacucugguaa

SEQ ID NO: 5349 - RNA, 9879 nt, Artificial Sequence
  derived and/or modified CDS sequence (wt) from DENV-1__KR028435__SS-prME
ucugugaccaugcuccuuaugcugaugccuacagccuuggcauuccauuugacuacacgagggggagagccgcacaugauagucagcaagcaggaaagaggaaagucacuuuuguuuaagaccucagcaggugucaacaugugcacccucauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccguugcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccaucuauggccaugcgaugcgugggaauaggcagcagggacuucguggaaggacugucaggagcaacuuggguagaugugguguuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggaugugggcucuucggaaaaggaagccuuauaacgugugccaaguucaagugugugacaaaacuggaaggaaaaauaguucaauaugaaaacuugaaauauucaguaauagucaccguccacacuggagaccagcaccaggugggaaaugaaagcacagaacaugggacaacugcaaccauaacaccucaagcuccuacgacagaaauacagcugaccgacuacggagcucuuacauuggauuguucaccuagaacaggacuggacuucaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcguugaccggagcgacggaaauccaaacgucuggaacgacaacaauuuuugcaggacacuugaaauguagacuaaagauggacaaacugacucuaaaagggaugucauaugugauaugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauagucacugacaaagaaaaaccagucaacauugaggcagaaccgccuuuuggugagaguuacaucgugauaggagcaggugaaaaggcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaauuggaaagguagagaacucaaaugugggaguggcauuuuugucacuaaugaaguucacacuuggacagagcaauacaaauuucaagcugauuccccaaagagacuaucagcagccauugggaaggcaugggaggaggguguguguggaauucgaucagcaacccgucucgagaacaucauguggaagcaaauaucaaaugaauugaaccacaucuugcuugaaaaugacaugaaauucacagugguuguaggagauguugcugggaucuuggcucaagggaaaaaaaugauuaggccacaacccauggaacacaaauacucguggaaaagcuggggaaaagcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaagacagcaaggcaguucaugcugacaugggguacuggauagaaagugaaaagaacgagaccuggaagcuggcaagagccucuuucauagaagucaaaacguguaucuggccaaaaucucacacucuauggagcaauggaguucuggaaagugaaaugauaauuccaaagaucuauggaggaccaauaucucagcacaacuacagaccaggauauuucacacaaacggcagggccguggcaucuaggcaaguuggaacuggauuuugauuugugugaggguaccacgguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgaccuaccuagcucugauggccacuuuuaaaaugagaccaauguuugccguagggcuacuauuccgcagacuaacauccagagaaguucuucuucuaacaauuggauugagucuaguggcaucuguggaguuaccaaauuccuuggaggagcugggggauggacuugcaaugggcauuaugaucuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuguugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccauugauagcuggaggcaugcuaauagcauguuaugucauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaauuucagggguguacccauuaucaauaccagcgacccuuuuugugugguacuuuuggcagaaaaagaaacagagaucuggaguguuaugggacacaccuagcccuccagaaguggaaagagcaguucuugaugauggcaucuauagaaucaugcagagaggacuguugggcaggucccaaguggggguaggaguguuucaagaaaacguguuccacacaauguggcaugucaccaggggagcuguacucauguaccaagggaagagacuggaaccgagcugggccagugucaaaaaagaccugaucucauauggaggagguuggaggcuucaaggauccuggaacacgggagaagaagugcaggugauugcuguugaaccagggaaaaaucccaaaaauguacaaacagcgccgggcacuuuuaagaccccugaaggcgaaguuggagccauugcccuagauuuuaagcccggcacaucuggaucucccaucgugaacagagaagggaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccugcauccaggaucgggaaaaacaagaagauaccuaccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccaccuucaccaugcgccuccugucucccgugagaguucccaauuauaacaugauuauuauggaugaagcacauuucaccgauccauccagcauagcggcuagaggguacaucucaacccgagugggcaugggugaagcagcugcgauuuucaugacagccacucccccaggaucaguggaggccuuuccacagagcaacgcaguuauccaagaugaggaaggaggaauuucugagagaucauggaacucagguuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucaucuuagcaggaccgaugccagugacuguggcuagugccgcccagaggagaggaagaauuggaaggaaccacaacaaggaaggugaucaguacaucuauaugggacagccuuuaaacaacgaugaagaucacgcucacuggacggaagcaaaaaugcuccuugauaauauaaacacaccagaaggaauuaucccagcccucuucgagccggagagagaaaagagugcggcaauagacggggaauacagacugcggggugaagcaaggaaaacguuuguggagcucaugagaagaggagaucuaccugucuggcuauccuacaaaguugccucagaaggcuuccaauacucugacagaagauggugcuuugacggggaaaggaacaaccagguguuggaagagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuggaaauagggaaacuuccacaacacuugacgcaaagggcccagaaugccuuggauaaccuggucauguugcacaacuccgaacaaggaggaagagccuauagacaugcaauggaagaacugccagacaccauagaaacguuaaugcuccuagcuuugauagcuguguuaacugguggagugacgcuauucuuccuaucaggaaggggcuuagggaaaacaucuaucggccuacucugcgugauggcuucaagcguauugcuauggauggccaguguagagccccauuggauagcggccuccaucauacuggaguucuuccugauggugcugcucauuccagagccagacagacaacgcacuccgcaggacaaucagcuggcauauguggugauagguuuguuauucaugauacuaacaguagcagccaaugagaugggacugcuggaaaccacaaagaaagacuuagggauuggccauguggcuguugaaaaccaccaccaugccacaaugcuggacguagacuuacauccagcuucagccuggacccucuaugcaguggccacaacaaucaucacucccaugaugaggcacacaaucgaaaacacaacggcaaacauuucccugacagccauugcaaaucaggcagcuauauugaugggacuugacaaaggauggccaauaucgaagauggacauaggaguuccacuucucgccuuggggugcuauucccaggugaauccacugacgcugacagcggcgguauugaugcuaguggcccauuacgcuauaauuggaccuggacugcaagcaaaagcuacuagagaagcucaaaaaaggacagcggccggaauaaugaaaaauccaacuguugauggaaucguugcaauagacuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcaguuuccauggcaaacauuuucagaggaaguuaucuagcaggagcaggucuggcuuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaggugaagggauacacaaaaggaggaccuggacacgaagaaccaaucccaauggcgaccuauggauggaaccuaguaaagcuguacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuggugcgaaauccacuuucaagaaauuccacucaugaaauguauuggguuucauguggaacaggaaacauugugucagcaguaaacaugacauccagaauguugcuaaaucgguucacaauggcucauaggaaaccaacauacgaaagagacguggaccuaggcgccggaacaagacauguggcaguagaaccagagguagcuaaccuagauaucauuggccagaggauagagaacauaaaacaugaacacaagucaacauggcauuaugaugaggacaauccauauaaaacaugggccuaucauggaucauaugaggucaaaccaucaggaucagccucauccauggucaaugguguggugaaacugcucaccaaaccaugggaugucauccccauggucacacaaauagcuaugacugacacuacacccuuuggacaacagaggguauuuaaagagaaaguugacacacgcacaccaaaagcaaaacgaggcacagcacaaaucauggaggugacagccaggugguuaugggguuuucuuucuagaaacaagaagccaagaauuuguacaagagaggaguucacaagaaaaguuaggucaaacgcagccaucggagcaguguucauugaugaaaaccaauggaacucagcaaaagaagcaguggaagaugagcgguucugggaccuugugcacagagagagggagcuucacaaacagggaaaaugugccacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguacgcugaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacugguuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaaccgcaugccuaggcaaaucauaugcacaaauguggcagcugauguacuuccacaggagagaccugagacuagcugcuaaugcuaucuguucagccguuccaguugauugggucccaacuagccgcaccaccuggucuauccaugcccaucaccaauggaugacaacagaagacaugcugucaguguggaauagaguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5350 - RNA, 9879 nt, Artificial Sequence
  derived and/or modified CDS sequence (wt) from DENV-1__JQ922548__SS-prME
ucugugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggacacaaugaccuacaaaugcccccggaucacugaagcggaaccagaugauguugauugcuggugcaaugccacagacacaugggugaccuaugggacguguucucaaacuggcgaacaccgacgggauaaacguucugucgcauuggccccacacgugggacuuggccucgaaacaagaaccgaaacguggauguccucugaaggcgccuggagacagauacaaaaaguggagaccugggccuugagacacccaggauucacggugauagcccuuuuucuagcacauaccauaggaacauccaucacccagaaagggaucaucuucauuuugcugaugcuggugacaccaucaauggccaugcgaugugugggaauaggcaacagagacuucguugaaggacugucaggagcaacauggguggaugugguacuggagcauggaagcugcgucaccaccauggcaagaaauaaaccaacauuggacauugaacucuugaagacggaggucacgaacccugccgucuugcgcaaacugugcauugaagcuaaaauaucaaacaccaccaccgauucaagauguccaacacaaggagaagccacacugguggaagaacaagacgcgaacuuugugugucgacgaacauucguggacagaggcugggguaaugguuguggacuauucgggaagggaagcuuacugacgugugcuaaguuuaagugugugacaaaacuugaaggaaaaauaguucaauaugaaaacuuaaaauauucggugauagucacuguccacacuggggaccagcaccaggugggaaaugagacuacagaacauggaacaauugcaaccauaacaccucaagcucccaugucggaaauacagcugaccgacuacggagcccuuacauuggacugcucaccuagaacagggcuggacuuuaaugagauggugcuguugacaaugaaagaaaagucauggcuuguccacaaacaaugguuucuagacuuaccacugccuuggaccucgggggcuucaacaucucaagagacuuggaacagacaagaucugcuggucacauuuaagacagcucaggcaaagaagcaggaaguagucguacuggggucacaagagggagcaaugcacacugcguugacuggggcgacagaaauccagacgucaggaacgacgacaauguuugcaggacaccugaaauguagacuaaaaauggauaaacugacuuugaaaggggcaucauaugugaugugcacaggcccuuuuaagcuagagaaggaaguggcugagacccagcauggaacuguccuagugcagguuaaauaugaaggaacagaugcaccaugcaagauuccauuuucaacccaagaugagaaaggagugacccagaaugggagauugauaacagccaaucccauaguuacugacaaagaaaaaccagucaacauugagacagaaccacccuuuggugagagcuacaucgugauaggggcgggugaaaaagcuuugaaacuaagcugguucaagaaaggaagcagcauagggaaaauguuugaagcuaccgcccgaggagcacgaaggauggccauccugggagacacagcaugggacuucgguuccauaggaggggcguucacaucugugggaaaauugguacaccagguuuuuggaaccgcauauggggucuuguucagcgguguuucuuggaccaugaaaauaggaauagggauccugcugacauggcuaggauuaaacucaaggagcacgucacucucgaugacgugcauugcaguuggcauggucacacuguaccuaggagucaugguucaagcggacucggggugugugaucaacuggaaaggcagagaacucaaauguggaaguggcaucuucgucacuaaugaaguccacacuuggacagagcaauauaaauuccaggcugacuccccaaaaagacuaucagcagccauugggaaggcaugggaggaaggcguguguggaauucgaucagccacacgucuugagaacaucauguggaagcaaauaucaaaugaauugaaccacauuuuacuugaaaaugacaugaaauucacagugguuguaggagacgcuaauggaaucuugacccaaggaaaaaagaugauuaggccacaacccauggaacacaaauacucauggaaaagcuggggaaaagccaaaauuauaggagcagaugcacagaauacuaccuucaucaucgauggcccagacacuccagaaugcccugaugaccagagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuaacgagagccuccuucauagaagugaagacaugcaccuggccaagaucccacacucuauggagcaauggaguccuggaaagugaaaugauaaucccaaagauauauggaggaccaauaucucagcacaacuacagaccaggguauuucacacaaacagcagggccauggcaccuaggcaaguuggaacuagauuuuaauuugugugaaggcaccacaguuguaguggaugaacauuguggaaacgggggugcaucucuuggaacuacaacagucacaggaaagauaauccaugaaugguguugcagauccugcacgcuaccccccuuacgcuucuuaggagaagauggauguugguauggcauggagaucagaccaguuaaggagaaggaggagaaucuauucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugccucagacagaauagggaugggaacaacguaccuagccuugauggccacuuucaaaaugagaccgauguucgcuguugggcuauuauuucgcagacuaacauccagagagguucuccuucucacaauuggacuaagccugguggcauccguggagcugccaaauucuuuagaagagcuaggggacggacuugcaaugggcaucaugauguuaaaauuauugacugauuuucagucacaccaguuauggaccaccuuacugucucugacauucaucaaaacaacucucucauuggauuaugcauggaagacaauagcuaugguauugucaaucguaucucucuuuccucuaugccuauccacgaccucucaaaaaacaacauggcuuccggugcuguuaggaucuuuuggauccaaaccacuaaccauguuucuuauaacagaaaacaaaaucuggggaaggaaaaguuggccccucaaugaaggaauuauggcuguuggaauagucagcauuuuacuaaguucacuccccaaaaaugaugugccacuagccggcccacuaauagcuggaggcaugcugauagcauguuacgucauauccggaagcucggccgauuuaucauuggagagagcggccgaggucuccugggaagaagaggcagaacacucuggcgccucacacaacauacuaguggagguccaagaugauggaaauaugaaaauaaaagaugaagaaagagaugauucgcucacuauacuccucaaagcaacuuuguuggcaguuucagggguguacccaaugucaauaccagcaacccuuuuugugugguauuucuggcagaaaaagaaacagagaucaggagucuugugggacacacccagcccuccagaagugguaagagcaguucuugaugaugguaucuauagaaucuugcaaagaggacuauuggguaggucccagguaggagugggaguuuuucaggacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccaggaaaaaacccaaaaaauguacagacaacgccuggcacuuucaagaccccugaaggcgaaguuggagccauagcccuagauuucaaaccuggcacaucuggaucucccaucgugaacagagaggguaaaauaguaggucuuuauggaaauggaguggugacaacaaguggaaccuacgucagugccauugcccaagcuaaagcaucacaagaagggccucuaccagagauugaggacgagguguuuaagaaaagaaaccuaacaauaauggaccuacauccaggaucaggaaaaacaagaagauaucuuccggccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaagggagauagucgaucucaugugccacgccaauuucaccaugcgucuccuauccccagugagaguucccaauuacaacaugauuaucauggaugaagcacacuuuacugauccagccagcauagcggccaggggguauaucucaacccgaguggguaugggugaagcagccgcgaucuuuaugacagccacucccccaggaucgguagaggccuuuccacagagcaaugcaguuauccaagaugaggaaagagacauuccugagagaucauggaacucaggcuacgacuggaucacugauuucccaggaaaaacagucugguuuguuccaagcaucaaaucaggaaaugacauugccaacuguuuaagaaagaacgggaaacgggugauucaauugagcagaaaaaccuuugacacugaauaccagaaaacaaaaaacaaugacugggacuauguugucacaacagacauuuccgaaaugggagcaaauucccgaaccgacaggguaauagacccaaggcggugcuugaagccgguaauacuaaaagauggcccagagcgcgucauucuagccggaccaaugccagugaccgcggccagugcugcccagaggagaggaagaauuggaaggaaccaaaacaaggaaggugaccaguauauauacaugggacagccuuugaauaaugaugaggaccacgcucauuggacagaagcaaaaaugcuccuugacaauauaaacacgccagaagggauuaucccagcccucuuugagccagagagagaaaagagugcagcaauagacggggaguacagacugcggggagaagcaaggaaaacguucguggagcuaaugagaagaggggaucuaccaguuuggcuaucuuacaaaguugccucagaaggcuuucaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacuuccacagcauuugacgcuaagggcccagaaugcuuuggacaacuuggucauguugcacaauuccgaacaagggggaaaagccuauagacaugcuauggaagaauuaccagacaccauagaaacauugaugcuacuggcuuugauagcugugcugacugguggaguuacguuguuuuuccuaucaggaaaaggucuagggaaaacauccauuggccuacuuugugugauggccucaaguguacuguuauggauggccaguguggagccccauuggauagcggccuccaucauacuagaguuuuuucugaaggagcugcucauuccagaugcagacggacagcguacuccacaggacaaucagcuagcauauguggugauagguuuguuauucaugauauugacaguggcagccaaugagaugggauuacuggaaaccacaaagaaaaaccuggggauuggccauguaguugcugaaaaccaccaccaugcuacaaugcuagacauagacuuacauccagcuucagccuggacccucuaugcaguagccacaacaauuaucacucccaugaugagacacacaauugaaaacacaacggcaaauauuucccugacagcuauugcaaaccaggcggcuauacugaugggacuugacaagggaaggccaauaucuaagauggacauaggagugccacuucucgccuuagggugcuauucccaggugaacccacugacacugacagcggcgguguugauguuaguggcucauuaugccauaaucggaccuggacugcaagcaaaagcuacuagagaagcccaaaaaagaacagcggccgguuuaaugaaaaauccaacuguagacgggauugcugcaauagauuuggauccugugguuuaugaugcaaaauuugaaaaacagcugggccaaauaauguuacuaauacucugcacaucacagauucucuugaugcggacuacaugggccuuaugugaauccaucacacuggcuacuggacccuugaccacucucugggagggaucuccuggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagaucugaagccaaggagggacugaaaagaggagaaacaaccaaacaugcagugucgagaggaacagccaaacuuaggugguuuguggagaggaaccuugugaaaccagaagggaaagugauagaccucgguugugggagagguggcuggucauauuacugcgccgggcugaagaagguuacagaagugaagggauacacaaaaggaggacccggucaugaggaaccuaucccaauggcgacuuauggauggaaccuagugaagcuacacuccggaaaggauguauucuuuacaccaccugagaaaugugacacccuuuugugugacauuggugaguccucuccgaauccaacuauagaagaaggaagaacguuacguguucuaaagaugguggaaccauggcucagaggaaaucaguuuugcauaaaaauccuaaauccuuacaugccaagugugguagaaacucuggagcaaaugcaaagaaaacauggagggaugcuagugcgaaacccacucucaagaaauucuacccaugaaauguacuggguuucaugugcaacaggaaacauugugucggcagugaacaugacauccagaauguugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaacauaugaggucaagccaucaggaucagccucauccauggugaacggcguggugagauugcucaccaagccaugggauguuauccccauggucacacaaauagcuaugacugauaccacacccuucggacaacagaggguauuuaaagagaaaguugacacacgcacaccaagaccaaaacgaggcacagcacaaauuauggaggugacagccaggugguugugggguuuccucucuagaaauaaaaaacccagaaucugcacaagagaggaguucacaagaaaaguuaggucaaacgcagcaauuggagcaguguucguugaugaaaaccaauggaacucagcaaaagaagcaguggaagacgaaagguucugggaccucgugcacagagagagggagcuucauaaacagggaaaaugugccacgugugucuacaauaugauggggaaaagagagaaaaaauuaggagaguuuggaaaggcaaaaggaagucgugcaauaugguacaugugguugggagcacgcuuucuagaguuugaagcccuuggcuucaugaaugaagaccacugguucaguagggagaauucacuuaguggaguggaaggagaaggacuacacaaacuuggauacauacuuagagacauaucaaagauuccagggggaaauauguaugcagaugacacagcuggaugggacacaagaauaacagaggaugaccuccagaaugaggcuaaaaucacugacaucauggagcccgaacaugcucuacuggcuacgucaaucuucaagcugaccuaucaaaauaaggugguaagggugcaaagaccagcaaaaaguggaaccgugauggacguuauauccagacgugaccagagaggaaguggacaggucggaacuuauggcuuaaacacuuucaccaacauggagguccaacuaauaagacagauggaaucugaaggaaucuuuucacccagcgaauuggaaaauucaaaucuagcugagagagcucucgacugguuggaaaaacauggcgucgaaagguugaaaagaauggcaaucagcggagaugacuguguggugaaaccaacugaugacagguucgcaacagcuuuaacagcccugaaugacaugggaaaagugagaaaagacauaccgcaaugugaaccuucaaaaggauggaaugacuggcagcaagugccuuucuguucacaccauuuccaccaacugaucaugaaggaugggagggagauaguggugccaugccguaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccacuuggucgauccaugcccaccaucaauggaugacaacagaagacauguuaucaguauggaauaggguuuggauagaggaaaacccauggauggaggacaaaacucauguauccagcugggcagauguuccauacuuaggaaaaagggaagaucaaugguguggaucccugauaggcuuagcagcgagagccaccugggccaccaacauacaaguggccuuaaaccaagugagaaggcucauugggaaugagaauuauuuagacuacaugacaucaaugaagagguucaagaaugagagcgaucccgaaggagcccucugguaa

SEQ ID NO: 5351 - RNA, 9879 nt, Artificial Sequence
  derived and/or modified CDS sequence (wt) from DENV-1__JQ922544__SS-prME
uccgugaccaugcuccucaugcugcugcccacagcucuggcguuccauuugaccacacgagggggagagccacacaugauaguuagcaagcaggaaagaggaaagucacucuuguuuaagaccucugcaggugucaauaugugcacccucauugcgauggauuugggagaguuaugugaggacacaaugaccuacaaaugcccccggaucacugaggcggaaccagaugacguugacugcuggugcaaugccacagacacaugggugaccuaugggacguguucucaaacuggcgaacaccgacgagacaaacguuccgucgcacuggccccacacgugggacuuggucuagaaacaagaaccgaaacguggauguccugugaaggcgccuggaaacaaauacaaaaaguggagauuugggcuuugagacacccaggauucacggugauagcccuuuuuuuagcacaugcgauaggaacauccaucacucagaaagggauuauuuucauuuugcugaugcugguaacaccaucaauggccaugcgaugugugggaauaggcaacagagaauucguugaaggacugucaggagcaacguggguggacgugguauuggagcauggaagcugccuccacaccauggcacaaaauaaaccaacauuggacauugaacuccugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacguucguggacagaggcugggguaauggcugcggacuauucggaaaaggaagccuacugacgugugcuaaguucaagugugugacaaaacuagaaggaaagauaguucaauaugaaaacuuaaaauauucagugauagucacuguccacacuggggaccagcaccaggugggaaacgagaccacaacccauggaacaauugcaaccauaacaccucaagcuccuacgucggaaauacagcugaccgacuacggagcccucacauuggacugcucaccuagaacaggguuggacuuuaaugagauggugcuauugacaaugaaagaaaaaucauggcuuguccacaaacaaugguuucuagacuuaccacugccuuggacuucgggggcuucaacaucucaagagacuuggaacagacaagauuugcuggucacauuuaagacagcucaugcaaagaagcaggaaguagucguacugggaucacaagaaggagcaaugcacacugcguugacuggggcaacagaaauccagacgucaggaacgacaacaaucuuugcaggacaccugaaaugcagacuaaaaauggauaaacugacuuuaaaagggaugucauaugugaugugcacaggcucauuuaaguuagagaaggaaguggcagagacccagcauggaaccguucuagugcagguuaaauacgaaggaacagaugccccaugcaagauccccuuuucgacccaagaugagaaaggagugacccagaaugggagauugauaacagccaaucccauaguuacugacaaagaaaaaccagucaacauugaggcagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguucacgucugugggaaaauugguacaucagguuuuuggaaccgcauaugggguucuguucagcgguguuucuuggaucaugaaaauaggaauagggauucugcugacaugguugggauuaaauucaaggagcacgucacuuucgaugacgugcauugcaguuggcauggucacacuguaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauugggaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaaucuuggcccaagggaaaaaaaugauuaggccacaacccauggaacacaaauacucauggaaaagcuggggaaaagccaaaaucauaggagcagacauacagaauaccaccuucaucaucgacggcccagauacuccagaaugccccgaugaccaaagagcauggaacauuugggaaguugaggacuauggguuuggaauuuucacgacaaacauauggcugaaacugcgugacuccuacacccaaaugugugaccaccggcuaaugucagcugccaucaaggacagcaaggcaguccaugcugauaugggguacuggauagaaagugaaaagaacgagaccuggaagcuagcgagagccuccuucauagaagucaagacaugcaucuggccgaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaacuagauuuugacuugugugaaggcaccacaguuguuguggaagaacauuguggaaaucgagguccaucucuuagaacuacaacagucacaggaaagauaauccaugaaugguguugcagauccugcacguuaccccccuuacgcuucaaaggagaagacggauguugguauggcauggaaaucagaccaguuaaggagaaggaagagaaccuaguuaggucaauggucucugcagggucaggggaaguggacaguuuuucauuaggacuacuaugcguaucaauaaugauugaagaagugaugagauccagauggaguagaaagaugcugaugacuggaacacuggcuguuuuccuccuucuuauaaugggacaacugacauggaaugaucugaucagguuaugcaucaugguuggagccaaugcuucagacaggauggggaugggaacaacguaccuagccuugauggccacuuucaaaaugagaccaauguucgcuguugggcuauuauuucgcagacuaacauccagagaaguucuucuucucacaauuggauuaagccugguggcauccguggagcuaccaaauucuuuagaggagcuaggggauggacuugcaaugggcaucaugauguuaaaauuauugacugauuuccagucacaccaguuauggacuaccuuauugucucugacauucaucaaaacaacucuuucauuggauuaugcauggaagacaauggcuaugguacugucaaucguaucucucuuuccuuuaugucugucuacgaccucucaaaaaacaacauggcuuccggugcuguuaggaucuuuuggaugcaaaccauuaaccauguuucuuauaacagaaaacaaaaucuggggaaggaaaaguuggccccucaaugaaggaauuauggcuguuggaauaguuagcauucuacuaaguucacuccucaaaaaugaugugccgcuagccggcccacuaauagcuggaggcaugcuaauaucauuuuuugucauauccggaagcucagccgauuuaucauuggagaaagcggcugagguauccugggaagaagaagcagaacacucugguaccucacacaacauauuaguggagguccaagaugauggaacuaugaaaauaaaagaugaagagagggaugacacacucaccauacuccuuaaagcaacucugcuggcagucucagggguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggaguuuuccaagacggcguguuccacacaauguggcacgucaccaggggagccguccucauguaccaagggaagaggcuggaaccaagcugggccagugucaaaaaagacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaagaagggccucuaccagagauugaggacgagguguuuaggaaaagaaacuuaacaauaauggaccugcauccaggaucaggaaaaacaagaagauaucuuccagccauaguccgugaggccauaaagaggaaacugcgcacgcuaaucuuggcucccacaagaguugucgccucugaaauggcagaggcgcucaagggaaugccaauaagauaucagacaacagcagugaagagugaacacacaggaagggagauaguugaccucaugugccacgccacuuucaccaugcgucucuuaucuccagugagaguucccaauuacaacaugauuaucauggaugaagcacauuuuaccgauccagccagcauagcggccagaggguacaucucaacccgagugggcaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuucccagguaaaacagucugguuuguuccaagcaucaaaucaggaaaugacauugccaacuguuuaagaaagaacggaaaacgggugauccaauugagcagaaaaaccuuugacacugaguaccagaaaacaaaaaacaaugacugggacuauguugucacaacagacauuuccgaaaugggagcaaauuuccgggccgacaggguaauagacccaaggcggugcuugaaaccgguaauacuaaaagaugguccagagcgcgucauucuagccggaccgaugccagugacuguggccagugcugcccagaggagaggaagaauuggaaggaaccaaaacaaggaaggugaucaguauguuaacaugggacaaccuuuaaauaaugaugaggaccacgcucauuggacagaagcaaaaaugcuccuugacaauauaaacacaccagaagggaucaucccagcccucuuugagccggagagaaaaaagagugcagcaguagacggggaguacagacugcggggagaagcaaggaaaacguucguggagcucaugagaagaggagaucuaccaguuuggcuauccuacaaaguugccucagaagguuuccaguacuccgacagaagguggugcuuugauggggaaaggaacaaccagguguuggaggagaacauggacguggagaucuggacaaaggaaagagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcuuuggacaacuuggucauguugcacaauuccgaacaaggaggaaaagccuauagacaugcuauggaggaacuaccagacaccauagaaacauugaugcuccuagcuuugauagcugugcugacugguggagugacgcuguucuuccuaucaggaaaaggucuagggaaaacauccauuggccuacucugugugauggccucaagcgcacuguuauggauggccaguguggagccccauuggauagcggccuccaucauacuagaguucuuucugauggugcugcucauuccagagccagacagacagcgcacuccacaagacaaccagcuagcauauguggugauagguuuguuauucaugauacugacaguggcagccaacgagaugggauuauuggaaaccacaaagaaagaccuggggauuggccauguagccgccgaaaaccaccaccaugcuacaaugcuggacguagaccuacguccagcuucagccuggacccucuaugcaguagccacaacaauuaucacucccaugaugagacacacaauugaaaacacaacggcaaauauuucccugacagccauugcaaaucaggcagcuauauugaugggacuugacaagggauggccaauaucuuugauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaauguuacugauacuuugcacaucacagauucucuugaugcggaccacaugggccuugugugaauccaucacacuggcuacuggacccuugaccacucuuugggagggaucuccaggaaaauucuggaauaccacgauagcaguauccauggcaaacaucuucaggggaaguuaucuagcaggagcaggucuggccuucucauuaaugaaaucuuuaggaggagguaggagagguacgggagcucaaggggaaacacugggagaaaaauggaaaagacagcuaaaccaacugagcaagucagaauucaacauuuacaaaaggagugggauuauggagguggacagauccgaagccaaagagggauugaaaagaggagaaacaaccaaacaugcagugucgagaggaacagccaaacugaggugguuuguggagaggaaccucgugaaaccagaagggaaagucauagaccucgguuguggaagagguggcuggucauauuauugcgcugggcugaagaaagucacugaagugaagggauacacaaaaggaggaccuggacaugaggaaccuaucccaauggcgaccuauggauggaaccuaguaaagcuacacucuggaaaagauguauucuuuacaccaccugagaaaugugacacccuuuugugugauauuggugaguccucuccgaauccaacuauagaagaaggaagaacguuacguguucuaaagaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugaggucaagccaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaacgaggcacagcacaaauuauggaggugacagccaagugguuaugggguuuccuuuccagaaacaaaaaacccagaaucugcacaagagaggaguucacaagaaaaguuaggucaaacgcagcaaugggagcaguguucguugaugaaaaccaauggaacucagcaaaagaagcaguggaagacgaaagguuuugggaucucgugcacagagagagggagcuucauaaacagggaaaaugugccacgugugucuacaauaugauggggaagagagagaaaaaauuaggagaguuuggaaaggcaaaaggaagucgugcaauaugguacaugugguugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagcccgaacaugcucuauuggcuacgucaauuuuuaagcugaccuaccaaaacaaggugguaagggugcaaagaccagcaaaaaguggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaaccccuaaucuagcugagagaguucucgacugguuggaaaaacauggcgccgaaaggcugaaaagaauggcaauuagcggagaugauuguguggugaaaccaauugaugacagguucgcaacagccuuaacagcucugaaugacaugggaaaaguaagaaaagacauaccacaaugggaaccuucaaaaggauggaaugacuggcagcaagugccuuucuguucacaccauuuccaccagcugaucaugaaggaugggagggagauaguggugccaugccgcaaccaagacaaacuugugggcagggcuagaguaucacaaggcgccggauggagccugagagaaacugcuugccuaggcaagucauaugcacaaauguggcagcugauguacuuccacaggagagaccugagacuagcggcuaaugcuaucuguucagccgucccaguugauugggucccaaccagccgcaccaccuggucgauccaugcccaccaccaauggaugacaacagaagacauguuaucaguguggaauaagguuuggauagaggaaaacccauggauggaggacaaaacucauguauccaguugggaagauguuccauacuuaggaaaaagggaagaucaaugguguggaucccugauaggcuuaacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5352 - RNA, 9879 nt, Artificial Sequence
  derived and/or modified CDS sequence (wt) from DENV-1__JQ922546__SS-prME
uccguggccaugcuccuuaugcugcugcccacagcccuggcguuccauuugaccacacgagggggagagccacacaugauaguuagcaagcaggaaagaggaaagucacuuuuguuuaagaccucugcaggugucaacaugugcacccucauugcgauggauuugggagaguuaugugaggacacaaugaccuacaaauggccccggaucacugaggcggaaccagaugacguugacugcuggugcaaugccacagacacaugggugaccuauggaacguguucucaaaccggcgaacaccgacgagacaaacguuccgucgcacuggccccacacguggggcuuggucuagaaacaagaaccgaaacguggauguccucugaaggcgccuggaaacaaauacaaaaaguagagacuugggcucugagacacccaggauucacggugauagcccuuuuucuagcacaugccauaggaacauccaucacccagaaagggaucauuuucauuuugcugaugcugguaacaccgucaauggccaugcgaugugugggaauaggcaacagagacuucguugaaggacugucaggggcaacguggguggaugugguacuggagcauggaagcugcgucaccaccauggcaaaaaacaaaccaacauuggacauugaacucuugaagacggaggucacgaaccccgccgucuugcgcaaauugugcauugaagcuaaaauaucaaacaccaccaccgauucaagauguccaacacaaggagaagcuacacugguggaagaacaagacgcgaacuuugugugucgacgaacguucguggacagaggcugggguaauggcuguggacuauucggaaaaggaagccuacucacgugugcuaaguucaagugugugacaaaacuagaaggaaagauaguucaauaugaaaacuuaaaauauucagugauagucacuguccacacuggggaccagcaccaggugggaaaugagaccacagaacauggaacaauugcaaucauaacaccucaagcuccuacgucggaaauacagcugaccgacuacggagcccucacauuggacugcucaccuagaacagggcuggacuuuaaugagauggugcuguugacaaugaaagaaaaaucguggcuuguccacaaacaaugguuucuagacuuaccacugccuuggaccucgggggccucaacaucucaagagacuuggaacagacaagaucugcuggucacauuuaagacagcucaugcaaagaagcaggaaguagucguacugggaucacaagaaggagcaaugcacacugcguugacgggggcgacagaaauccagacgucaggaacaacaacaaucuuugcaggacacuuaaaaugcagacuaaaaauggauaaacugacuuuaaaagggaugucauaugugaugugcacaggcucauuuaaguuagagaaggaaguggcugagacccagcauggaaccgucuuagugcagguuaaauacgaaggaacagaugcaccaugcaagauccccuuuucgauccaagaugagaaaggagugacccagaaugggagauugauaacagccaaucccauaguuacugacaaagaaaaaccagucaacauugagacggaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggauuucgguucuauaggaggaguguucacgucugugggaaaacuaguacaccagguuuuuggaaccgcauaugggguuuuguucagcgguguuucuuggaccaugaaaauaggaauagggauucugcugacauggcuaggauuaaauucaaggagcacgucacuuucgaugacgugcauugcaguuggcauggucacacuguaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaagacuaucagcagccauugggaaggcaugggaggagggcguguguggaauucgaucagccacacgucuugagaacgucauguggaagcaaauaucaaaugaauugaaccacauucuacuugaaaaugacaugaaauuuacagugguugugggagauguuaauggaauccuggcccagggaaagaaaaugauuaggccacaacccauggagcacaaauacucauggaaaagcuggggaaaagccaaaaucauaggagcagacauacagaauacuaccuucauuaucgacggcccagacacuccagaaugccccgaugaccaaagagcauggaacauuugggaaguugaggacuauggguuuggaauuuucacgacaaacauauggcugaaauugcgugacuccuacacccaaguaugugaccaccggcuaaugucagcugccaucaaggacagcaaggcaguccaugcugacaugggguacuggauagaaagugaaaagaacgagaccuggaaguuggcgagagccuccuuuauagaaguuaagacaugcaccuggccaaaaucccacacucuauggagcaauggaguucuggaaagugaaaugauaaucccaaagauauauggaggaccaauaucucagcacaacuacagaccaggguauuucacacaaacagcagggccauggcaccuaggcaaguuggaacuagacuuugauuuaugugaaggcaccacaguuguuguggaugaacauuguggaaaucgagguccaucucuuagaacuacaacagucacaggaaagauaauccaugaaugguguugcagauccugcacguuaccccccuuacgcuucaaaggagaagacggauguugguauggcauggaaaucagaccaguuaaggagaaggaagagaaccuagucaggucaauggucucugcagggucaggagaaguggacaguuuuucauuaggacuacuaugcguaucaauaaugauugaagaagugaugagauccagauggaguagaaagaugcugaugacuggaacacuggcuguuuucuuccuucuuauaaugggacaacugacauggaaugaucuguucagguuaugcaucaugguuggagccaaugcuucagacaggauggggauggggacaacauaucuagcccugauggccacuuucaaaaugagaccaauguuugcuguugggcuauuauuucgcagacuaacauccagagaaguucuucuucucacaauuggauuaagccugguggcauccguggagcuaccaaauucuuuagaggagcuaggggauggacuugcaaugggcauuaugauguuaaaauuacugacugauuuucagucacaccaguuauggacuaccuuacugucucugacauuuaucaaaacaacucuuucauuggauuaugcauggaagacaauggccaugguacugucaaucguaucucucucuccuuuaugucuguccacgaccucucaaaaaacaacauggcuuccggugcuguuaggaucuuuuggauguaaaccacuaaccauguuccuuauaacagaaaacaaaaucuggggaaggaaaaguuggccccucaaugaaggaauuauggcuguuggaauaguuagcauucuacuaaguucacuccuaaaaaaugaugugccgcuagccggcccacuaauagcuggaggcaugcuaauagcauguuauguuauauccggaagcucagccgacuuaucauuggagaaagcggcugaggucuccugggaagaagaggcagaacacucuggugccucacacaacauacuaguggagguccaagaugauggaacuaugaaaauaaaagaugaagagagagaugacacacucaccauacuccuuaaagcaucucugcuggcagucucagggguguauccaaugucaauaccagcaacccuuuuugugugguauuuuuggcagaaaaagaaacagagaucaggaguguuaugggacacacccagcccuccagaaguggaaagagcaguucuugaugaugguaucuauagaaucuugcaaagaggacuguugggcaggucccaaguaggagugggaauuuuccaagauggcguguuccacacaauguggcacguuaccaggggagcuguccucauguaucaagggaagaggcuggaaccaagcugggccagugucaaaaaagacuugaucucauauggaggagguuggagguuucaaggaucauggaacacgggagaagaagugcaggugauagcuguugaaccaggaaaaaaccccaaaaauguacagacaacgccgggcaucuucaagaccccugaaggcgaaguuggagccauaacccuagauuucaaacccggcacaucuggaucucccaucgugaacagagagggaaaaauaguaggucuuuauggaaauggaguggugacaacaaguggaaccuacgucagugccauugcccaagcuaaagcaucacaagaagggccucuaccagagauugaggacgaaguguuuaggaaaagaaacuuaacaauaauggaccuacauccaggaucaggaaaaacaagaagguaucuuccagccauaguccgugaggccaugaaaaggaaacugcgcacgcuaaucuuggcucccacaagaguugucgccucugaaauggcagaggcgcucaagggaaugccaauaagauaccagacaacagcagugaagagugaacacacaggaagggagauaguugaccuuaugugccacgccacuuucaccaugcgucuccuaucuccagugagaguucccaauuacaacaugauuaucauggaugaagcacauuuuaccgauccagccagcauagcggcuaggggguacaucucaacccgaguggguaugggugaagcagcugcgaucuucaugacagccacucccccaggaucgguggaggccuucccacagagcaaugcaguuauccaagaugaggaaagagacauuccugagagaucauggaacucaggcuacgauuggaucacugauuucccaggcaaaacagucugguuuguuccaagcaucaaaucaggaaaugacaucgccaacuguuuaagaaagaacgggaaacgggugauccaauugaguagaaaaaccuuugacacugaguaccagaaaacaaaaaacaaugacugggacuauguugucacaacagacauuuccgaaaugggagcaaauuuccgggccgacaggguaauagacccaaggcggugcuugaaaccgguaauacuaaaagaagguccagagcgcgucauucuagccggaccgaugccagugacuguggccagugcugcccagaggagaggaagaauuggaaggaaccaaaauaaggaaggugaucaguacguuuacaugggacagccuuuaaauaaugaugaggaccaugcucauuggacagaagcaaaaaugcuccuugaccauauaaacacaccagaagggauuaucccagcccucuuugagccagaaagagagaagagugcagcaauagacggggaguacaggcugcggggagaagcaaggaaaacguucguggagcucaugagaagaggagaucuaccaguuuggcuauccuacaaaguugccucagaaggcuuccaauacaccgauagaagguggugcuuugauggggaaaggaacaaccagguguuggaggagaacauggacguggagaucuggauggaagaaggggaaaaaaagaaaauucgaccccgcugguuggaaauagaaaaauauucugauccacuggcccuccgcgaguuuaaagaguuuucagcaaaaagaaaaaguguuuuaggggaccuaaaauuagaaauagggaaacuuccacaacauuugacgauaaaggcccggaaugccuuggacaacuuggucauguugcacaauuccgaacaaggaggaaaagccuauagacacgcuauggaagaacuaccagacaccauagaaacauugaugcgcuuagguuugauagcugugaugacugguggagugacucuguuuuuccuaucaggaaaaggucuagggaaaacauccaauggucuacucugugugauggccucaagcguacugcuauggauggccaguguggagccccauuggauagcggccuccaucauacuagaguucuuucugauggugcugcucauuccagagccagauagacagcgcacuccacaggacaaccaguuagcauauguggugauagguuuguuauucaugauauugacaguggcagccaaugagaugggauuauuggaaacuacaaagaaagaccuggggauuggccauguagucgccgaaaaccaccaccaugcuacaaugcuggacguagaccuacauccagcuucagccuggacccucuaugcaguagcuacaacaauuaucacucccaugaugagacacacaauugaaaacacaacggcaaauauuucccugacagcuauugcaaaucaggcagcaauauugaugggacuugacaagggauggccaauaucgaagauggacauaggaguuccacuucucgccuuagggugcuauucccaggugaacccauugacacugacagcggcgguguugauguuaguggcucauuaugccauaauuggaccuggauugcaagcaaaagcuacgagagaagcucaaaaaaggacagccccccaaauaaugaagaaucaaauuguagacgggauuguugcaguagauuuggauccugugguuuacgaugcaaaauuugaaaaacagcuaggccaaauaauguuacugauacuuugcacaucacagauucucuugaugcggacuacaugggccuugugugaauccaucacacuggcuacuggaccuuugacuacucuuugggagggaucuccaggaaaauucuggaacaccacgauagcaguguccauggcaaacaucuucaggggaaguuaucuagcaggagcaggucuggccuucucauuaaugaaaucuuuaggaggaggcaggagaggcacgggagcucaaggggaaacacugggagagaaauggaaaagacagcuaaaccaacugaguaagucagaauucaacacuuacaaaaggagugggauuauggagguggacagauccgaagccaaagagggacugaaaagaggagaaacaaccaaacaugcagugucaagaggaacagccaaacugaggugguuuguggagaggaaccucgugaaaccagaagggaaagucauagaccucgguuguggaagagguggcuggucauacuauugcgcugggcugaagaaagucacagaagugaagggauacacaaaaggaggaccuggacaugaggaaccuaucccaauggcgaccuacggauggaaccuaguaaagcuacacucuggaaaagauguauucuuuacaccaccugagaaaugugacacccuuuugugugauauuggugaguccucuccgaauccaacuauagaagaaggaagaacguuacguguucuaaagaugguggaaccauggcucagaggaaaccaauuuugcauaaaaauccuaaauccuuacaugccaagugugguggaaacccuggagcaaaugcaaagaaaacauggagggaugcuagugcgaaacccacucucaagaaauuccacccacgaaauguacuggguuucauguggaacaggaaacauugugucggcagugaacaugacauccagaauguugcugaaucgauucacaauggcucacaggaagccaacauaugaaagagacguggacuuaggugcuggaacaagacauguggcaguggaaccagagguagccaaccuagauaucauuggccagaggauagagaacauaaaaaaugaacauaagucaacauggcauuaugaugaggacaauccauacaaaacaugggccuaucacggaucauaugaggucaagccaucaggaucagccucauccauggugaauggcguggugagacugcucaccaaaccaugggauguuauccccacggucacacaaauagcuaugacugauaccacacccuucgggcaacagaggguguucaaagagaaaguugacacgcgcacaccaaaagcaaaacgagguacagcacaaauuauggaagugacagccaauugguuauggggcuuccuuucuagaaacaaaaaacccagaaucugcacaagagaggaguucacaagaaaaguuaggucaaacgcagcaauuggagcaguguucguugaugaaaaccaauggaacucagcaaaagaagcaguggaagaugaaagguuuugggaucuugugcacagagagagggagcuucauaaacagggaaaaugugccacgugugucuacaauaugauggggaagagagagaaaaaauuaggagaguuuggaaaggcaaaaggaagucgugcaauaugguacaugugguugggagcacgcuuucuagaguucgaagcccuugguuucaugaaugaagaucacugguucaguagagagaauucacucaguggaguggaaggagaaggacuacacaaacucggauacauacucagagacauaucaaagauuccagggggaaauauguaugcagaugacacagccggaugggacacaagaauaacagaggaugaucuucagaaugaggcuaaaaucacugacaucauggagcccgaacaugcucuauuggcuacaucaauuuuuaagcugaccuaccaaaauaaggugguaagggugcaaagaccagcaaaaaguggaaccgugauggaugucauauccagacgugaccagagaggaaguggacaggucggaacuuauggcuuaaauacuuucaccaacauggagguucaacuaauaagacaaauggagucugagggaaucuuuuuacccagcgaacuggaaaccccuaaucuagcugagagaguccucaacugguuggaaaaacauggcgucgaaaggcugaaaagaauggcaaucagcggagaugacuguguggugaaaccaacugaugacagguucgcaacagcuuuaacagcucugaaugacauggggaaaguaagaaaagacacaccgcaaugggaaccuucaaaaggauggaaugacuggcagcaagugccuuuuuguucacaccauuuccaccagcugaucaugaaggaugggagggagauaguggugccaugccgcaaccaagaugaacucgugggcagggccagaguaucacacggcgccggauggagccugagagaaacugcuugccuaggcaagucauaugcgcaaauguggcagcugauguacuuccacaggagagaccugagacuggcggcuaaugcuaucuguucagccguuccaguugauugggucccaaccagccgcaccaccuggucgauccaugcccaucaccaauggaugacaacagaagacauguuaucaguguggaauagggucuggauagaggaaaacccauggauggaggacaaaacucauguauccaguugggaagauguuccauacuuaggaaaaagggaagaucagugguguggauccauuauaggcuugacagcaagggccacuugggccacuaacauacaaguagccauaaaccaagugagaaggcucaucgggaaugagaauuaucuagauuacaugacaucaaugaagagauucaagaaugagagugaucccgaaggggcacucugguaa

SEQ ID NO: 5353 - RNA, 9879 nt, Artificial Sequence
  derived and/or modified CDS sequence (wt) from DENV-1__JQ922545__SS-prME
uccgugaccaugcuccuuaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggacacaaugaccuacaaaugcccccggaucacugaagcggaaccagaugauguugauugcuggugcaaugccacagacacaugggugaccuaugggacguguucucaaacuggcgaacaccgacgggauaaacguucugucgcauuggccccacacguggggcuuggucuagaaacaagaaccgaaacguggauguccucugaaggcgccuggagacagauacaaaaaguggagacuugggccuugagacacccaggauucacggugauagcccuuuuucuagcacauaccauaggaacauccaucacccagaaagggaucaucuucauuuugcugaugacgggagcacccaucauggccaugcgaugugugggaauaggcaacagagacuucguugaaggacugucgggagcaccguggguggaugugguacuggagcauggaagcugccucuccaacauggcaaaaaauaaaccaacauuggacauugacuucuuuaagacggaggucacgaacccugccgucuugcgcaaacugugcauugaagcuaaaauaucaaacaccaccaccgauucaagaugcccaacacaaggagaagcuacacugguggaagaacaagacgcgaacuuugugugucgacgaacauucguggacagaggcugggguaaugguuguggacuauucgggaaaggaagcuuacugacgugugcuaaguuuaagugugugacaaaacuugaaggaaagauaguucaauaugaaaacuuaaaauauucggugauagucacuguccacacuggggaccagcaccaggugggaaaugagaccacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccacugccuuggaccucgggggcuucaacaucucaagagacuuggaacagacaagauuugcuggucacauuuaagacagcucaugcaaagaagcaggaaguagucguacuggggucacaagaaggagcaaugcacacugcguugacuggggcgacagaaauccagaugucaggaacgacgacaaucuucgcaggacaccugaaauguagacuaaaaauggauaaacugacuuuaaaaggggugucauaugugaugugcacaggcucauuuaaguuagagaaggaaguggcugagacccagcauggaaccguccuagugcagguuaaauacgaaggaacagaugcaccaugcaagauucccuuuucaacccaagaugagaaaggagugacccagaaugggagauugauaacagccaaucccauaguuacugacaaagaaaaaccagucaacauugagacagaaccaccuuuuggugagagcuacaucgugauaggggcgggugaaaaagcuuugaaacuaagcugguucaagaaaggaagcagcauagggaaaauguucgaagcuaccgcccgaggagcacgaaggauggcuauccugggagacacagcaugggacuucgguuccauaggagggguguucacaucugugggaaaauugguacaccagguuuuuggaaccgcauauggggucuuguucagcgguguuucuuggaccaugaaaauaggaauagggauucugcugacauggcuaggauuaaauucaaggagcacgucacucucgaugacgugcauugcaguuggcauggucacacuguaccuaggagucaugguucaagcggacucggggugugugaucaacuggaagggcagagaacucaaauguggaaguggcaucuucgucacuaaugaaguccacacuuggacagagcaauauaaauuccaggcugacuccccaaaaagacugucagcagccauugggaaggcaugggaggaaggcguguguggaauucgaucagccacuugucuugagaacaucauguggaagcaaauaucaaaugaauugaaccacauucuacuugaaaaugacaugaaauucacagugguuguaggagacgcuaauggaaucuugacccaaggaaaaaagaugauuaggccacaacccauggaacacaaauacucauggaaaagcuggggaaaagccaaaaucauaggagcagauauacagaauaccaccuucaucaucgauggcccagacacuccagaaugccccgaugaccagagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuugauuugugugaaggcaccacaguuguuguggaugaacauuguggaaaucgagguccaucucuuagaacuacaacagucacaggaaagauaauccaugaaugguguugcagauccugcacgcuaccccccuuacgcuucaaaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacaggauggggaugggaacaacguaccuagccuugauggccacuuucaaaaugagaccgauguucgcuguugggcuauuauuucgcagacuaacauccagagagguucuccuucucacaauuggacuaagccugguggcauccguggagcuaccaaauucuuuagaggagcuaggggacggacuugcaaugggcaucaugauguuaaaauuauugacugauuuucagucacaccaguuauggacuaccuuacugucucugacauucaucaaaacaacucuuucauuggauuaugcauggaagacaauagcuaugguauugucaaucguaucucucuuuccuuuaugucuaucuacgaccucucaaaaaacaacauggcuuccggugcuguuaggaucuuuuggaugcaaaccacuaaccauguuucuuauaacagaaaacaaaaucuggggaaggaaaaguuggccccucaaugaaggaauuauggcuguuggaauagucagcauuuuacuaaguucacuccucaaaaaugaugugccacuagccggcccacuaauagcuggaggcaugcuaauagcauguuacgucauauccggaagcucagccgauuuaucauuggagaaagcggcugaggucuccugggaagaagaagcacaacacucuggugccucacacaacauacuaguggagguccaagaugauggaacuaugaaaauaaaagaugaagagagagaugacacgcucacuauacuccuuaaagcaacucuguuggcagucucagggguguacccaaugucaauaccagcaacccuuuuugugugguauuuuuggcagaaaaagaaacagagaucaggagucuugugggacacacccagcccuccagaaguggaaagagcaguucuugaugaugguaucuauagaaucuugcaaagaggacuguuggguaggucccaaguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugagccagggaagaacccaaaaaauguacagacaacgccgggcaccuucaagaccccugaaggcgaaguuggagccauagcccuagauuuuaaacccggcacaucuggaucucccaucgugaacagagagggaaaaauaguaggccuuuauggaaauggaguggugacaacaaguggaaccuacgucagugccauugcccaagcuaaagcaucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaagggagauaguugaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuucccaggaaaaacagucugguuuguuccaagcaucaaaucaggaagugacauugccacuguuuuagaaaggagcagggaaccggugauccaauuaagcagaaaaaccuuugacacugaauaccagaaaacaaaaaacaaugacugggacuauguugucacaacagacauuuccgaaaugggagcaaauuuccgggccgacaggguaauagacccaaggcggugcuugaagccgguaauaccaaaagauggcccagagcgcgucauucuagccggaccaaugccagugaccguggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaacacgccagaagggauuaucccagcccucuuugagccggagagagaaaagagugcagcaauagacggggaguacagacugcggggagaagcaaggaaaacguucguggagcuaaugagaagaggggaucuaccaguuuggcuaucuuacaaaguugccucagaaggcuuccaguacuccgacagaagguggugcuuugacggggaaaggaacaaccagguguuggaggagaacauggacguggagaucuggacaaaagaaggagaaagaaagaaauuacgaccucgcugguuagaugccagaaccuacucugauccacuggcccugcgcgaguuuaaagaguucgcagcaggaagaagaagugucucaggugaccuaauauuagaaauagagaaacuuccacagcauuugacgcuaagggcccagaaugcuuuggacaacuuggucauguugcacaauuccgaacaaggaggaaaagccuauagacaugcuauggaagaauuaccagacaccauagaaacauugaugcuccuagcuuugauagcugugcugacugguggagugacguuguuuuuccuaucaggaaaaggucuagggaaaacauccauuggccuacuuugugugauggccucaaguguacuguuauggauggccaguguggagccccauuggauagcggccuccaucauacuagaguucauucugauggugcugcucauuccagagccagacagacagcguacuccacaggacaaucagcuagcauauguggugauagguuuguuauucaugauauugacaguggcagccaaugagaugggauuacuggaaaccacaaagaaagaccuggggauuggccauguagucgccgaaaaccaccaccaugcuacaaugcuagacauagacuuacauccagcuucagccuggacccucuaugcaguagccacaacaauuaucacucccaugaugagacacacaauugaaaacacaacggcaaauauuucccugacagcuauugcaaaucaggcggcuauauugaugggacuugacaagggauggccaauaucgaagauggacauaggagugccacuucucgccuuagggugcuauucccaggugaacccauugacacugacagcggcgguguugauguuaguggcucauuaugccauaaucggaccuggacugcaagcaaaagcuacuagagaagcccaaaaaaggacagcggccggaauaaugaaaaauccaacuguagacgggauuguugcaauagauuuggauccugugguuuacgaugcaaaauuugaaaaacagcuaggccaaauaauguuacugauacuuugcacaucacagauucucuugaugcggacuacaugggccuuaugugaauccaucacacuggcuacuggacccuugaccacucucugggagggaucuccaggaaaauucuggaauaccacgauagcaguguccauggcaaacaucuucaggggaaguuaucuagcaggagcuggucuggccuucucauuaaugaaaucuuuaggaggagguaggagagguacgggagcucaaggggaaacauugggagaaaaauggaaaagacaacuaaaccaacugagcaagucagaauucaacacuuacaaaaggaguggaauuauggagguggacagaucugaagccaaggagggacugaaaagaggagaaacaaccaaacaugcagugucgagaggaacagccaaacuuaggugguuuguggagaggaaccuugugaaaccagaagggaaagugauagaccucgguuguggaagagguggcuggucauauuauugcgcugggcugaagaagguuacagaagugaagggauacacaaaaggaggacccggucaugaggaaccuaucccaauggcgacuuauggauggaaccuagugaagcuacacuccggaaaagauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuacaugccaagugugguagaaacucuggagcaaaugcaaagaaaacauggagggaugcuagugcgaaacccacucucaagaaauucuacccaugaaauguacuggguuucauguggaacaggaaacauugugucggcagugaacaugacauccagaauguugcugaaucgguucacaauggcucacaggaagccaacauaugaaagagacguggacuugggcgcuggaacaagacauguggcaguggaaccagagauagccaaccuagacaucauuggccagaggauagagaacauaaaaauuggacauaagucaacauggcauuaugaugaggacaauccauacaaaacaugggccuaucauggaucauaugaggucaagccaucagggucagccucauccauggugaauggcguggugagauugcucaccaaaccaugggauguuauccccauggucacacaaauagcuaugacugauaccacacccuucggacaacagaggguguuuaaagagaaaguugacacacgcacaccaagaccaaaacgaggcacagcacaaauuauggaggugacagccaaguggaugugggguuuccucuuuagaaacagaccacccagaauuugcacaagagaugaguucgcaagaaaaguuaggucaagcacagcaaauggagcaguguucguugaugaaaaucaauggaacucagcaaaagaagcaguggaagacgaaagguuuugggaccucgugcacagagagagggagcuucauaaacagggaaaaugugccacgugugucuacaauaugauggggaaaagagagaaaaaauuaggagaguuuggaaaggcaaaaggaagucgugcaauaugguacaugugguugggagcacgcuuucuagaguuugaagcccuuggcuucaugaaugaagaccacugguucaguagagagaauucacucaguggaguggaaggagaaggacuacacaaacuuggauacauacucagagacauaucaaagauuccagggggaaauauguaugcagaugacacagcuggaugggacacaagaauaacagaggaugauucuucgaaugaggcuaaaaucauugaacucaugaggcccgaacaugcuuuacuugcuacgucaaucuucaagcugaccuuccaaauaagugugguaagggugcaaagaccagcaaaaaguggaaccgugauggaauguauauccagacgugaccagaaaagaaguggacaggucggaacuuauggcuuaaacacuuucaccaacauggagguccaacuaauaagacaaauggaaucugaaggaaucuuuucacccagcgaaauggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaagugagaaaagacauaccgcaaugggaaccuucaaaaggauggaaugacuggcagcaagugccuuucuguucacaccauuuccaccaacugaucaugaaggaugggagggagauaguggugccaugccgcaaccaagaugaacuugugggcagggccagaguaucacaaggcgccggauggagccugagagaaacugcuugccuaggcaagucauaugcacaaauguggcagcugauguacuuccacaggagagaccugagacuagcggccaaugcuaucuguucagccguuccaguugauugggucccaaccagccgcaccaccuggucgauccaugcccaccaccaauggaugacaacagaagacauguuaucaguguggaauaggguuuggauagaggaaaacccauggauggaggacaaaacucauguauccaguugggaagauguuccauacuuaggaaaaagggaagaucaaugguguggaucccugauaggcuuaacagcaagggccaccugggccaccaacauacaaguggccauaaaccaagugagaaggcucauugggaaugagaauuauuuagacuacaugacaucaaugaagagauucaagaaugagagugaucccgaaggagcccucugguaa

SEQ ID NO: 5354 - RNA, 9879 nt, Artificial Sequence
  derived and/or modified CDS sequence (wt) from DENV-1__GU131887__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaagcugaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccucuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagcuuaauaacgugugcuaaguucaagugugugacaaaacuggaaggaaagauaguucaauaugaaaacuugaaauauucaguaauaguuaccguucacaccggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuagauaugaaggaacagaugcaccaugcaagaucccuuuuucgacccaagaugaaagaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugcuagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacguccuuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggagaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaagaugcugaugacuggaacacuggcuguguuccuccuucucauaaugggacaauugacauggaaugaucugaucagacuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuccuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauucaucaaaacaacguuuuccuugcacuaugcauggaagacaauggcuaugguacugucaauuguaucucucuuucccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggacgaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggagaaguuggagccauugccuuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaaaggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaaugaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccuacgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcugcguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggaccccgugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaauaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuguaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucauaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggacgucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaagcugaccuaccagaauaaggugguaaggguacagagaccagcaaaaaauggaaccgugauggaugucauauccagacgugaccagagaggaaguggccagguuggaacuuauggcuuaaacacuuuuaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagauuagccgccaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5355 - RNA, 9879 nt, Artificial Sequence
  derived and/or modified CDS sequence (wt) from DENV-1__GU131888__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagccgaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaagcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaauuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuuugacccaagaugaaaaaggaguaacccagaaugggagauugauaacagcuaacccuauaguuacugacaaagaaaaaccagucaacauugaggcagaaccgcccuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccggaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaaacuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcugucuuugacauucaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggacccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagcgccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcacuaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcagaaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuugcauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugacgggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccuugguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaaacuaggagaguucggaaaggcaaaaggaagucgugcaauaugguacaugugguugggagcacgcuuucuagaguucgaagcucuugguuucaugaacgaagaucacugguucagcagggagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagauuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggagcacucugguga

SEQ ID NO: 5356 - RNA, 9879 nt, Artificial Sequence
  derived and/or modified CDS sequence (wt) from DENV-1__GU131892__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcugggguaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuugguucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccagacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaagggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaguauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5357 - RNA, 9879 nt, Artificial Sequence
  derived and/or modified CDS sequence (wt) from DENV-1__GU131893__SS-prME
ucugugaccaugcuccucaugcugaugccuacagccuuggcguuccauuugacuacacgagggggagagccgcacaugauagucagcaagcaggaaagaggaaaaucacucuuguucaagaccucagcaggugucaacaugugcacccuuauagcgauggauuugggagaguuaugugaggacacaaugacuuacaaaugcccucgaaucacugaagcugaaccagaugacguugacuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggugcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagauaaaccaacauuagacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcuuuucggaaaagggagccuaaugacgugugcuaaguucaagugugugacaaaacuggaaggaaagauaguucaauaugaaaacuugaaauauucaguaauagucaccguucacaccggagaccagcaucaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggagcaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggauuagggguucugcugacauggcuaggauuaaacucaaggagcacgucccuuucgaugacgugcauugcaguuggccuaguaacacuauacuuaggagucaugguucaggcggauucaggauguguaaucaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauucccauacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuccuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucagggaaaacaagaagauaccuuccagccauaguccgugaggccauaaaaaggaagcugcguacacuaauucuggcucccacaagaguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggagccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuucuuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguggacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccccugaccacgcuuugggagggaucuccaggaaaauuuuggaacaccacgauagcgguuuccauggcaaacauuuucagaggaaguuaucuagcaggggcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgucuggcuggaaaaauauggcgucgaaaggcugaaaagaauggcaaucagcggagaugacugcguggugaaaccaauugaugauagguuugcaacagccuuaacagcucugaaugacaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5358 - RNA, 9879 nt, Artificial Sequence
  derived and/or modified CDS sequence (wt) from DENV-1__GU131894__SS-prME
ucugugaccaugcuccucaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauagucacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggacuaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggagcagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggcuagugucaaaaaagaccugaucucauauggaggagguuggaggcuucaaggauccuggaacacaggagaagaagugcagguaauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuauaugggacagccuuuaaacaacgaugaagaucacgcucacuggacagaagcaaaaaugcuucuugauaauauaaacacaccggaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaauagauucacaauggcucacagaaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaggagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauaaggagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccaggucggaacuuaugguuuaaacacuuucaccaacauggaagcccagcugauaagacaaauggagucugagggaaucuuuucacccagcgaauuagagaccccaaacuuagccgagagaguucucgacugguuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaccccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaucaagugagaagacuaauugggaaugagaauuaccuagauuacaugacaucaaugaagagauucaagaacgagagugaucccgaaggggcacucugguga

SEQ ID NO: 5359 - RNA, 9879 nt, Artificial Sequence
  derived and/or modified CDS sequence (wt) from DENV-1__GU131895__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaagcagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagauguggugcuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaucuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacuggcucuaaaagggaugucauaugugaugugcacaggcucauucaagcuagagaaagaaguggcugagacccagcauggaaccguucuagugcagauuaaauaugaaggaacagaugcaccaugcaagaucccuuuuucaacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacacugcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacaugcaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaauuggauuuugauuugugugagggaaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggcuagugucaaaaaagaccugaucucauauggaggagguuggaggcuucaaggauccuggaacacaggagaagaagugcagguaauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacauuucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaagacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauaaagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcucagcugauaagacaaauggagucugagggaauauuuucacccagcgaauuagagaccccaaacuuagccgagagaguucucgacuggcuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagagaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5360 - RNA, 9879 nt, Artificial Sequence
  derived and/or modified CDS sequence (wt) from DENV-1__GQ868632__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaauguccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcucccacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagacuugcuggugacauuuaagacagcccaugcaaagaagcaggaaguagucguacuaggaucacaagaaggagcaaugcacacugcguugaccggagcaacagaaauccaaacgucuggaacgacaacgauuuuugcaggacacuugaaaugcagacuaaagauggacaaacugacucuaaaaggggugucauaugugaugugcacaggcucauuuaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaaucaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguugugggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugagcaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacgguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaagggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccugucuacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucauuucucaaaaaugaugugccgcuagcugggccacuaauagcuggaggcaugcuaauagcauguuauguuauaucuggaagcucagccgaccuaucacuagagaaagcggcugagguuuccugggaagaagaagcagaacauucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguggggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcagguaauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacgguguuugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccgaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugauacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauaaagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaucacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5361 - RNA, 9879 nt, Artificial Sequence
  derived and/or modified CDS sequence (wt) from DENV-1__GQ868633__SS-prME
ucugugaccaugcuccucaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauagucacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggacuaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagauccugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggagcagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggcuagugucaaaaaagaccugaucucauauggaggagguuggaggcuucaaggauccuggaacacaggagaagaagugcagguaauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugcuauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuauaugggacagccuuuaaacaacgaugaagaucacgcucacuggacagaagcaaaaaugcuccuugauaauauaaacacaccggaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaagcaaccaaacaugcagugucgagaggacccgcuaaacugagaugguuuguggagaggaaccuugugaacccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacagaaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauaaggagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugggucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuaugguuuaaacacuuucaccaacauggaagcccagcugauaagacaaauggagucugagggaaucuuuucacccagcgaauuagagaccccaaacuuagccgagagaguucucgacugguuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuggucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaucaagugagaagacuaauugggaaugagaauuaccuagauuacaugacaucaaugaagagauucaagaacgagagugaucccgaaggggcacucugguga

SEQ ID NO: 5362 - RNA, 9879 nt, Artificial Sequence
  derived and/or modified CDS sequence (wt) from DENV-1__GU131919__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcguuaccacuauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaucaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguccuagugcagauuaaauaugaaggaacagaugcaccaugcaagaucccuuuuuugacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaauacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuugcgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucauaucagcugugggccaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccgcuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuggcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggcuauaaaaaggaaguugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguauuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguguucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaucuagauaucauuggccagaggauagagaacauaaaacaugaacacaagucaacauggcauuaugaugaggacaauccauauaaaacaugggccuaucauggaucguaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucucucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucaguagagagaauucacucagcggaguagaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5363 - RNA, 9879 nt, Artificial Sequence
  derived and/or modified CDS sequence (wt) from DENV-1__GU131920__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacauggaacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacagagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagauccugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggcuagugucaaaaaagaccugaucucauauggaggagguuggaggcuucaaggauccuggaacacaggagaagaagugcagguaauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaggcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucccccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacuccuaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauaaagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcgcucugguga

SEQ ID NO: 5364 - RNA, 9879 nt, Artificial Sequence
  derived and/or modified CDS sequence (wt) from DENV-1__GU131921__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcagguguuaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauggcacuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccacuauggcaaaagacaaaccaacauuggacauugaacucuugaagacggaagucacaaacccugccauccugcgcaaacugugcaucgaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaucaggugggaaaugaaagcacagaacaugggacaacugcaacuauaacaccucaagcuccuaugacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguuaaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggagcugcauauggaguuuuguucagcgguguuuccuggaccaugaaaauaggaauagggguucugcugacauggcuaggauuaaacucaaggagcacgucccuuucgaugacgugcauugcgguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuuuacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacuuuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacgauucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccgcuaauagcuggaggcaugcuaauagcauguuauguuauaucuggaagcucagccgaccuaucacuagagaaagcggcugaggucuccugggaagaagaagcagaacacucuggugccucacacaacauauuaguggagguucaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaaaagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaauaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaagucgccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggcuuugugcgaauccaucacacuggccaccggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugagaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguagaaggagaaggacuccacaaacuuggauauauacucagagacauaucaaagauuccagggggaaacauguaugcagaugacacagccggaugggacacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaauauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggauuccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5365 - RNA, 9879 nt, Artificial Sequence
  derived and/or modified CDS sequence (wt) from DENV-1__GQ868635__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcagguguuaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauggcacuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccacuauggcaaaagacaaaccaacauuggacauugaacucuugaagacggaagucacaaacccugccauccugcgcaaacugugcaucgaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaucaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguuaaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggagcugcauauggaguuuuguucagcgguguuuccuggaccaugaaaauaggaauagggguucugcugacauggcuaggauuaaacucaaggagcacgucccuuucgaugacgugcauugcgguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacuuuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacgauucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccgcuaauagcuggaggcaugcuaauagcauguuauguuauaucuggaagcucagccgaccuaucacuagagaaagcggcugaggucuccugggaagaagaagcagaacacucuggugccucacacaacauauuaguggagguucaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaaaagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaauaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaagucgccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggcuuugugcgaauccaucacacuggccaccggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguagagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugagaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguagaaggagaaggacuccacaaacuuggauauauacucagagacauaucaaagauuccagggggaaacauguaugcagaugacacagccggaugggacacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaauauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggauuccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5366 - RNA, 9879 nt, Artificial Sequence
  derived and/or modified CDS sequence (wt) from DENV-1__GQ868636__SS-prME
ucugugaccaugcuacuuaugcugaugcccacagccuuggcguuccaucugacuacacgagggggagagccacauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggcuaugcgaugcgugggaauaggcaguagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcaaauccuauagucacugacaaagaaaaaccagucaacauugaggcagaaccgcccuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccucguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagggcauggaacauuugggaaguugaggacuauggauuuggaauuuucacgacaaauauaugguugaaauugcgugacuccuacacucaagugugugaccaccggcuaaugucagcugccaucaaggacagcaaggcaguccaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuucaaaggagaagauggguguugguacgguauggaaaucagaccaguuaaggaaaaggaagagaaucuagucaaaucaauggucucugcaggguuaggggaaguggacagcuuuucacuaggacugcuaugcauaucaauaaugaucgaagaggugaugagauccagauggaguagaaaaauguugauggcuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaagaugagaccaauguuugcugucgggcuauuauuccguagacuaacauccagagaaguucuccuucuuacaauuggauugagucuaguggcaucuguggaguuaccaaauuccuuggaagagcugggggauggacuugcaaugggcauuaugauuuuaaaauuauugacugacuuucagucacaucagcugugggcuaccuugcuguccuugacauuuaucaaaacaacgcuuuccuuacaccaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcucgcugggccacuaauagcuggaggcaugcuaauagcauguuauguuauaucuggaagcucagccgacuuaucauuagagaaagcggcugaggucuccugggaagaagaagcagaacacucuggugccucgcacaauauauuaguggagguccaagaugauggaacuaugaagauaaaggaugaagagagagaugacacgcuaaccauucuucuuaaagcaacucugcuagcaauuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaaggaaagagacuggaaccgaguugggccagcgucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaagacaagaagauaucucccagccauaguccgugaggccauaaaaagaaagcugcgcacacuaauuuuggcucccacaagaguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcagaaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccuguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccauuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaggacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugaguaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacucugggaaagacguauucuuuacaccaccugagagaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacccuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccaggggggaauauguaugcagaugacacggccggaugggauacaaggauaacggaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggcauccaacauacaaguggccauaaaccaagugagaagacuaauugggaaugagaauuaucuagauuacaugacaucaaugaagagauucaagaacgagggugaucccgaaggggcacucugguga

SEQ ID NO: 5367 - RNA, 9879 nt, Artificial Sequence
  derived and/or modified CDS sequence (wt) from DENV-1__GU131922__SS-prME
ucugugaucaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaagucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggcuagugucaaaaaagaccugaucucauauggaggagguuggaggcuucaaggauccuggaacacaggagaagaagugcagguaauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaucucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguuuugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugaaaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuacaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaagggaaagucauagaccucggcuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauaaagaaagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaacuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5368 - RNA, 9879 nt, Artificial Sequence
  derived and/or modified CDS sequence (wt) from DENV-1__GU131923__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagaugcgaacuuugugugucgacgaacgguuguggacagaggcuggggcaauggcugugggcucuuuggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagccucaacaucacaagagacuuggaacagacaagacuugcuggugacauuuaagacagcucaugcaaagaagcaggaaguugucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaauaacccagaaugggagauugauaacagcuaaccccauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguauuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcaggaccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcugucuuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuccucauagcagaaaacaaaaucuggggaaagagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcaaagaggacuguugggcaggucccaaguagggguaggaguuuuccaagaaaacguguuccacacaauguggcauguuaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuaccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguuccuaauuacaacaugauuaucauggaugaagcacauuucaccgauccauccaguauagcggccagaggguacauuucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuagaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccaugaggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuuuagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacacuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagacguggaccuaggcgccggaacgagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5369 - RNA, 9879 nt, Artificial Sequence
  derived and/or modified CDS sequence (wt) from DENV-1__GQ868637__SS-prME
ucugugaccaugcuccuuaugcugaugccuacagccuuggcguuccauuugacuacacgaggaggagagccgcacaugauaguuagcaagcaggaaagaggaaagucacuuuuguucaagaccucagcaggugucaacaugugcacccuuauagcgauggauuugggagaguuaugugaggacacaaugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagagccgaaacguggauguccucugagggcgcuuggaaacagauacaaagaguggagacuugggcccugagacacccaggauucacggugauagcccuuuuucuagcacaugccauaggaacauccaucacccagaaagggauuauuuucauuuuguuaaugcuggugacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccgucuugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagccugauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuacgucggaaauacagcugaccgacuacggagcucuuacauuggauugcucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaaccgccagaggagcacgaaggauggccauacugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacacuauaccuaggagucaugguucaggcggauucaggauguguaauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauauucguggaaaagcuggggaaaagcuaaaaucauaggggcagauguacagaacaccaccuucaucaucgacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaacgagaccuggaagcuggcaagagccucuuucauagaaguuaaaacauguaucuggccaaaaucccacacccuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggguguugguacgguauggaaaucagaccggucaaggaaagggaagagaaucuagucaaaucaauggucucugcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugauuugaucagguuaugcaucaugguuggagccaacgcuuccgacaggauggggaugggaacgacguaccuagcuuugauggcuacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucacaucagcugugggcuacccugcuguccuugacauuuaucaaaacaacguuuuccuugcacuaugcauggaagacaauggcuaugguacugucaauuguaucucuccuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaauguguuccacacaauguggcaugucaccaggggagcuguacucauguaucaagggaagagacuggaaccgaguugggccagugucaaaaaagaccugaucucauauggaggagguuggaggcuccaaggauccuggaacacgggagaagaagugcaggugauugcuguugaaccagggaaaaaccccaaaaauguacaaacagcgccgggcaccuucaagaccccugaaggugaaguuggagccauugcccuagauuuuaaacccggcacaucuggaucuccuaucgugaacagagaagggaaaauaguaggucuuuauggaaauggaguagugacaacaaguggaaccuaugucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaccuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucgucacaacagacaucuccgaaaugggagcaaacuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcccacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucuggcuauccuacaaaguugccucagaaggcuuccaguacuccgacagaagauggugcuuugacggggaaaggaacaaccagguguuggaggagaacauggacguggagaucuggacaaaagaaggagaaagaaagaaacuacgaccccgcuggcuggacgccagaacauacucagacccacuggcccugcgcgaguuuaaagaguuugcagcaggaagaagaagcgucucaggugauuuaauauuagaaauagggaaacuuccacaacacuugacgcaaagggcccagaaugccuuggacaaccuggucauguugcacaacuccgaacaaggaggaagagccuauagacaugcaauggaagagcugccagacacuauagaaacguugaugcuccuagcuuugauagcuguguuaacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuuccugauggugcugcuuauuccagagccagacagacaacgcacuccgcaagacaaccagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucccaagugaauccacugacgcugauagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauucuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuacaaaaggagugggauaauggaaguggacagauccgaagccaaagagggacuaagaagaggagaaacaaccaaacaugcagugucgagaggaaccgccaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaccuggauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacgaggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugcgccacauguguuuacaacaugauggggaagagagagaaaaaacuaggagaguucggaaaggcaaaaggaagucgugcaauaugguacauguggcugggagcacgcuuucuagaguucgaagcucuugguuuuaugaacgaagaucacugguucagcagagagaauucacucagcggaguggaaggagaaggacuccacaaacucggauauauacucagagacauaucaaagauuccugggggaaauauguaugcagaugacacagccggaugggauacaaggauaacagaggaugaccuucagaaugaggccaaaauuacugacaucauggagcccgaacaugcccuacuggcuacgucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcuaauaagacaaauggagucugagggaaucuuuucaccuagcgaauuggagaccccaaauuuagccgagagaguucucgacuggcuggaaaaauauggcgucgaaaggcugaaaagaauggcaaucagcggagaugacugcguggugaaaccaauugaugacagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccuaagagaaacugcaugccuaggcaagucauaugcacaaauguggcaacugauguacuuccacaggagagaccugagacuagccgcuaaugcuaucuguucagccguuccaguugauugggucccaaccagccgcaccaccuggucgauccaugcccaucaccaauggaugacaacagaagauauguugucaguguggaauaggguuuggauagaugaaaacccauggauggaggacaaaacccauauauccaguuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugaucccgaaggggcacuaugguga

SEQ ID NO: 5370 - RNA, 9879 nt, Artificial Sequence
  derived and/or modified CDS sequence (wt) from DENV-1__GQ868639__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaaaugcccucgaaucucugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggcaaugcgaugugugggaauaggcagcagggacuucguagaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguagaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacgucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauuccuuuuucgacccaagaugaaaaaggaguaacucagaauggaagacugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagauaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggcuuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacauuuuacuugaaaaugacaugaaauuuacagugguuguaggagauguugcuggaauuuuggcucaagggaaaaaaaugauuaggccacaacccauggaauacaaguacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacgaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaagcuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaaugacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauucuaaaauuauuggcugacuuucaaucacaucaguugugggccaccuugcuguccuugacauuuaucaaaacaacguuuuccuugcacuaugcauggaagacaauggccaugguacugucaauuguaucucucuuucccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacugauagccggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagagaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggaacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucagcggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcucaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuggcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaauucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugcagcaaugcuggacguagacuuacauccagcuucagccuggacccucuaugcaguggccacaacaauuaucacucccaugaugaggcacacaauagaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaggcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaaccgcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuuuguaccacccgagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaagcauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguagcaguggaaccagagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacaccacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugcgccacguguguuuacaacaugauggggaagagagagaaaaaacuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuucagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauaucuagacgugaccagagaggaaguggccaggucggaacuuauggcuuaaauacuuucaccaacauggaagcccagcugauaagacagauggagucugaaggaaucuuuucacccagcgaauuagagaccccaaauuuagccgagagagcucucgacuggcuggaaaaacauggcguugaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucuauccaugcccaucaccaauggaugacaacagaagacaugcugucaguguggaauaggguuuggauagaggaaaacccauggauggaggacaaaacccauauauccaguugggaagauguuccauauuuaggaaaaagggaagaucagugguguggaucccugauaggcuuaacagcaagggccaccugggccacuaacauacaaguggccauaaaccaagugagaaggcuaauugggaaugagaauuaucuagauuacaugacaucaaugaagagauucaagaacgagagugauccugaaggggcacucugguga

SEQ ID NO: 5371 - RNA, 9879 nt, Artificial Sequence
  derived and/or modified CDS sequence (wt) from DENV-1__GU131925__SS-prME
ucugugaccaugcuccuuaugcugaugccuacagccuuggcauuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauauugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcagccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcauguuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccauugugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgaggggaaccgcuaaacugagaugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5372 - RNA, 9879 nt, Artificial Sequence
  derived and/or modified CDS sequence (wt) from DENV-1__GU131926__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaaaugcccucgaaucucugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggcaaugcgaugugugggaauaggcagcagggacuucguagaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguagaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacgucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauuccuuuuucgacccaagaugaaaaaggaguaacucagaauggaagacugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagauaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggaguaaacucaaggagcacgucccuuucgaugacgugcauugcaguuggcuuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacauuuuacuugaaaaugacaugaaauucacagugguuguaggagauguugcuggaauuuuggcucaagggaaaaaaaugauuaggccacaacccauggaauacaaguacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacgaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaagcuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuaguuaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaaugacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauucuaaaauuauugacugacuuucaaucacaucaguugugggccaccuugcuguccuugacauuuaucaaaacaacguuuuccuugcacuaugcauggaagacaauggccaugguacugucaauuguaucucucuuucccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacugauagccggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagagaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggaacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgcgaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucagcggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcucaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuggcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaauucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugcagcaaugcuggacguagacuuacauccagcuucagccuggacccucuaugcaguggccacaacaauuaucacucccaugaugaggcacacaauagaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaaccgcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuuuguaccacccgagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaagcauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguagcaguggaaccagagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacaccacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugcgccacguguguuuacaacaugauggggaagagagagaaaaaacuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuucagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauaucuagacgugaccagagaggaaguggccaggucggaacuuauggcuuaaauacuuucaccaacauggaagcccagcugauaagacagauggagucugaaggaaucuuuucacccagcgaauuagagaccccaaauuuagccgagagagcucucgacuggcuggaaaaacauggcguugaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucuauccaugcccaucaccaauggaugacaacagaagacaugcugucaguguggaauaggguuuggauagaggaaaacccauggauggaggacaaaacccauauauccaguugggaagauguuccauauuuaggaaaaagggaagaucagugguguggaucccugauaggcuuaacagcaagggccaccugggccacaaacauacaaguggccauaaaccaagugagaaggcuaauugggaaugagaauuaucuagauuacaugacaucaaugaagagauucaagaacgagagugauccugaaggggcacucugguga

SEQ ID NO: 5373 - RNA, 9879 nt, Artificial Sequence
  derived and/or modified CDS sequence (wt) from DENV-1__FJ639669__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuuggcucaaggaaaaaaaaugauuaggccacaacccauggaauauaaauacucguggaaaagcuggggaaaggcuaaaaucauaggggcagauguacagaacaccaccuucaucaucgacggcccaaacaccccagaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaccuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacauuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaaggaaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuauguugcacaacuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacagcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccugagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5374 - RNA, 9882 nt, Artificial Sequence
  derived and/or modified CDS sequence (wt) from DENV-1__FJ639670__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcaaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugccaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaucuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuuggcucaaggaaaaaaaaugauuaggccacaacccauggaauauaaauacucguggaaaagcuggggaaaggcuaaaaucauaggggcagaugcacagaacaccaccuucaucaucgacggcccaaacaccccagaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaccuagcucugauggccacuuuuaaaaugagaccaauguuugcuguggggcugcuauuccgcagacuaacauccagagaaguucuucuucuaacaauuggauugagucuaguggcaucuguagaguuaccaaauuccuuggaggagcugggggauggacuugcaaugggcauuaugauuuuaaaauuauugacugacuuucaaucacaucagcugugggcuaccuugcuguccuugacauuuaucaaaacaacauuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaaggaaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguauucugacagaagauggugcuuugacggggaaaggaacaaccagguguuggaggagaacauggacguggagaucuggacaaaagaaggagucucaagaaagaaccuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuauguugcacaacuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauagccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaauguuggacguagacuuacauccagcuucagccuggacccucuaugcaguggccacaacaauuaucacucccaugaugaggcacacaaucgaaaacacaacagcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaaggcagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauuaaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuucaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaaggaaacauggaggaaugcuagugcgaaauccacuuucaagaaauucuacccaugaaauguauuggguuucauguggaacaggaaacauugugucagcagugaacaugacauccagaauguugcuaaaucgauucacaauggcucacaggaaaccaacauaugaaagagacguggaccuaggcaccggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaguuuggaaaggcaaaaggaagucgugcaauaugguacaugugguugggagcacgguuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccugagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5375 - RNA, 9879 nt, Artificial Sequence
  derived and/or modified CDS sequence (wt) from DENV-1__FJ639671__SS-prME
ucugugaccaugcuccuuaugcugaugccuacagccuuggcguuccauuugacuacacgaggaggagagccgcacaugauaguuagcaagcaggaaagaggaaagucacuuuuguucaagaccucagcaggugucaacaugugcacccuuauagcgauggacuugggagaguuaugugaggacacauugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagagccgaaacguggauguccuccgaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagccugauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuacgucggaaauacagcugaccgacuacggagcucuuacauuggauugcucaccuagaacaggacuagacuuuaaugaaaugguguuguugacaaugaaagaaaaaucauggcuaguccacaaacaaugguuucuagaccuaccacugcccuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacaccugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagauggaaaaggaguaacccagaaugggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaaccgccagaggagcacgaaggauggccauacugggagacaccgcaugggacuuugguucuguaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacacuauaccuaggagucaugguucaggcggauucaggauguguaauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaaugucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucguggaaaagcuggggaaaagcuaaaaucauaggggcagauguacagaacaccaccuucaucaucgacggcccaaacaccucagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcagggcaguucacgcugauaugggguacuggauagaaagugaaaagaacgagaccuggaagcuggcaagagccucuuucauagaaguuaaaacauguaucuggccaaaaucccacacccuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaccgaggaccaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucugcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucagguuaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucuguuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguggggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaagaaccccaaaaauguacaaacagcgccgggcaccuucaagaccccugaaggugaaguuggagccauugcccuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacauacaggaagagagauaguugaccuuaugugucacgccacuuucaccaugcgucuccugucuccugugagaguucccaauuacaacaugauuaucauggaugaagcacauuucaccgauccauccagcauagcggccagaggauacaucucaacccgagugggcaugggagaagcagcugcgaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucgucacaacagacaucuccgaaaugggagcaaacuuccgggccgacagggugauagacccaagacggugucugaaaccgguaauacuaaaagaugguccagagcguguuaucuuagcaggaccgaugccagugacuguggccagugccgcccagaggagaggaagaauuggaaggaaccacaauaaggaaggugaucaguacaucuacaugggacagccuuuaaacaacgaugaagaucacgcccacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucuggcuauccuacaaaguugccucagaaggcuuccaguacuccgacagaagauggugcuuugacggggaaaggaacaaccagguguuggaggagaacauggacguggagaucuggacaaaagaaggagaaagaaagaaacuacgaccucgcuggcuggaugccagaacauacucagacccacuggcccugcgcgaguucaaagaguuugcagcaggaagaagaagcgucucaggugauuuaauauuagaaauagggaaacuuccacaacacuugacgcaaagggcccagaaugccuuggacaaccuggucauguugcacaacuccgaacaaggaggaagagccuauagacaugcaauggaagaacugccagagacuauagaaacguugaugcuccuagcuuugauagcuguguuaacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuuccugauggugcugcuuauuccagagccagacagacaacgcacuccgcaagacaaccagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggaggggucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuacaaaaggagugggauaauggaaguggacagauccgaagccaaagagggacuaagaagaggagaaacaaccaaacaugcagugucgagaggaaccgccaaacugaggugguuuguggagaggaaccuugugaaaccagaagggaaagucauagaccucgguuguggaagagguggcuggucauacuauugcgcugggcuaaagaaagucacagaagugaagggauauacaaaaggaggaccuggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucauaggaaaccaacauacgaaagagacguggaccuaggugcuggaacaagacauguggcaguggaaccagagguagccaaccuggauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacgaggcacugcacaaaucauggaggugacagccaggugguuauggggcuuucuuuccagaaacaaaaaaccaagaauuuguacaagagaggaguucacaagaaaaguuaggucaaacgcagccauuggagcaguauucguugaugaaaaucaauggaacucagcaaaagaagcaguggaagaugagcgguucugggaccuugugcacagagagagggagcuucacaaacagggaaaaugcgccacguguguuuacaacaugauggggaaaagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagcccgaacacgcccuacuggcuacgucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaauauggcgucgaaaggcugaaaagaauggcaaucagcggagaugacugcguggugaaaccaauugaugacagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaacugauguacuuccacaggagagaccugagacuagccgcuaaugcuaucuguucagccguuccaguugauugggucccaaccagccgcaccaccuggucgauccaugcccaucaccaauggaugacaacagaagacauguugucaguguggaauaggguuuggauagaggaaaacccauggauggaggacaaaacccauauauccaguuggggagauguuccauauuuagggaaaagggaagaucagugguguggaucccugauaggcuuaacagcaagggccaccugggccaccaacauacaaguggccauaaaccaagugagaagacuaauugggaaugaaaacuacuuagauuacaugacaucaaugaagagauucaagaacgagagugaucccgaaggggcacucugguga

SEQ ID NO: 5376 - RNA, 9879 nt, Artificial Sequence
  derived and/or modified CDS sequence (wt) from DENV-1__JN819423__SS-prME
ucugugaccaugcuccuuaugcugaugccuacagccuuggcguuccauuugacuacacgaggaggagagccgcacaugauaguuagcaagcaggaaagaggaaagucacuuuuguucaagaccucagcaggugucaacaugugcacccuuauagcgauggacuugggagaguuaugugaggacacauugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagagccgaaacguggauguccuccgaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagccugauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuacgucggaaauacagcugaccgacuacggagcucuuacauuggauugcucaccuagaacaggacuagacuuuaaugaaaugguguuguugacaaugaaagaaaaaucauggcuaguccacaaacaaugguuucuagaccuaccacugcccuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacaccugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagauggaaaaggaguaacccagaaugggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaaccgccagaggagcacgaaggauggccauacugggagacaccgcaugggacuuugguucuguaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacacuauaccuaggagucaugguucaggcggauucaggauguguaauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaaugucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucguggaaaagcuggggaaaagcuaaaaucauaggggcagauguacagaacaccaccuucaucaucgacggcccaaacaccucagaaugcccugaugaucaaagagcauggaacauuugggaaguugaggacuauggauuuggaauuuucacgacaaacauauggcugaaauugcgugacuccuacacccaagugugugaccaccgacuaaugucagcugccaucaaggacagcagggcaguucacgcugauaugggguacuggauagaaagugaaaagaacgagaccuggaagcuggcaagagccucuuucauagaaguuaaaacauguaucuggccaaaaucccacacccuauggagcaauggaguucuggaaagugaaaugauaauuccaaagaucuauggaggaccaauaucucagcacaauuacagaccaggauauuucacacaaacggcagggccguggcaccuaggcaaguuggaacuggauuuugauuugugugaggguaccacaguuguuguggaugaacauuguggaaaccgaggaccaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucugcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucagguuaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucuguuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguggggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaagaaccccaaaaauguacaaacagcgccgggcaccuucaagaccccugaaggugaaguuggagccauugcccuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacauacaggaagagagauaguugaccuuaugugucacgccacuuucaccaugcgucuccugucuccugugagaguucccaauuacaacaugauuaucauggaugaagcacauuucaccgauccauccagcauagcggccagaggauacaucucaacccgagugggcaugggagaagcagcugcgaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucgucacaacagacaucuccgaaaugggagcaaacuuccgggccgacagggugauagacccaagacggugucugaaaccgguaauacuaaaagaugguccagagcguguuaucuuagcaggaccgaugccagugacuguggccagugccgcccagaggagaggaagaauuggaaggaaccacaauaaggaaggugaucaguacaucuacaugggacagccuuuaaacaacgaugaagaucacgcccacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucuggcuauccuacaaaguugccucagaaggcuuccaguacuccgacagaagauggugcuuugacggggaaaggaacaaccagguguuggaggagaacauggacguggagaucuggacaaaagaaggagaaagaaagaaacuacgaccucgcuggcuggaugccagaacauacucagacccacuggcccugcgcgaguucaaagaguuugcagcaggaagaagaagcgucucaggugauuuaauauuagaaauagggaaacuuccacaacacuugacgcaaagggcccagaaugccuuggacaaccuggucauguugcacaacuccgaacaaggaggaagagccuauagacaugcaauggaagaacugccagagacuauagaaacguugaugcuccuagcuuugauagcuguguuaacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuuccugauggugcugcuuauuccagagccagacagacaacgcacuccgcaagacaaccagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacucgacaaaggauggccaauaucgaagauggacauaggaguuccacuucucgccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggaggggucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuacaaaaggagugggauaauggaaguggacagauccgaagccaaagagggacuaagaagaggagaaacaaccaaacaugcagugucgagaggaaccgccaaacugaggugguuuguggagaggaaccuugugaaaccagaagggaaagucauagaccucgguuguggaagagguggcuggucauacuauugcgcugggcuaaagaaagucacagaagugaagggauauacaaaaggaggaccuggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucauaggaaaccaacauacgaaagagacguggaccuaggugcuggaacaagacauguggcaguggaaccagagguagccaaccuggauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacgaggcacugcacaaaucauggaggugacagccaggugguuauggggcuuucuuuccagaaacaaaaaaccaagaauuuguacaagagaggaguucacaagaaaaguuaggucaaacgcagccauuggagcaguauucguugaugaaaaucaauggaacucagcaaaagaagcaguggaagaugagcgguucugggaccuugugcacagagagagggagcuucacaaacagggaaaaugcgccacguguguuuacaacaugauggggaaaagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagcccgaacacgcccuacuggcuacgucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaauauggcgucgaaaggcugaaaagaauggcaaucagcggagaugacugcguggugaaaccaauugaugacagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaacugauguacuuccacaggagagaccugagacuagccgcuaaugcuaucuguucagccguuccaguugauugggucccaaccagccgcaccaccuggucgauccaugcccaucagcaauggaugacaacagaagacauguugucaguguggaauaggguuuggauagaggaaaacccauggauggaggacaaaacccauauauccaguuggggagauguuccauauuuagggaaaagggaagaucagugguguggaucccugauaggcuuaacagcaagggccaccugggccaccaacauacaaguggccauaaaccaagugagaagacuaauugggaaugaaaacuacuuagauuacaugacaucaaugaagagauucaagaacgagagugaucccgaaggggcacucugguga

SEQ ID NO: 5377 - RNA, 9879 nt, Artificial Sequence
  derived and/or modified CDS sequence (wt) from DENV-1__FJ639672__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaagcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagccgauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuuggcucaaggaaaaaaaaugauuaggccacaacccauggaauauaaauacucguggaaaagcuggggaaaggcuaaaaucauaggggcagauguacagaacaccaccuucaucaucgacggcccaaacaccccagaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaccuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacauuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucaggaguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaaggaaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaagccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuucgacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuauguugcacaacuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacagcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggauagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacgcauucuucauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagcgugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauaucauuggccagaggauagagaacauaaaacaugaacacaagucgacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcagcagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccugagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5378 - RNA, 9879 nt, Artificial Sequence
  derived and/or modified CDS sequence (wt) from DENV-1__FJ639673__SS-prME
ucugugaccaugcuccuuaugcugaugccuacagccuuggcauuccauuugacuacacgaggaggagagccgcacaugauaguuagcaagcaggaaagaggaaagucacuuuuguucaagaccucagcaggugucaacaugugcacccucauagcgauggauuugggagaguuaugugaggacacaaugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagccugauaacgugugcuaaguucaagugugugacaaaacuggaaggaaagauaguucaauaugaaaauuugaaauauucaguaauagucaccguccacacuggagaccagcaccaggugggaaaugaaagcacagaacaugggacaacugcaacuauaacaccucaagcuccuacgucggaaauacagcugaccgacuacggagcucuuacauuggacugcucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacaccugaaauguagacuaaagauggacaaacugacucuaaaagggaugucauaugugaugugcacagguucauucaagcuagagaaagaaguggcugagacccagcauggaaccguucuagugcagauuaaauacgaaggaacagaugcaccaugcaagaucccuuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacacuauaccuaggagucaugguucaggcggauucaggauguguaauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaacgagaccuggaaguuggcaagagccucuuuuauagaaguuaaaacauguaucuggccaaaaucccacacccuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucaggucaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcuguggucucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaagacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaccuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucguuacaacagacaucuccgaaaugggagcaaacuuccgggccgacagggugauagacccaagacggugucugaaaccgguaauacuaaaagaugguccagagcgugucaucuuagcaggaccgaugccagugacuguggccagugccgcccaaaggagaggaagaauuggaaggaaccacaauaaggaaggugaucaguacaucuacaugggacagccuuuaaacaacgaugaagaucacgcccacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucuggcuauccuacaaaguugccucagaaggcuuccaguacuccgacagaagauggugcuuugacggggaaaggaacaaccagguguuggaggagaacauggacguggagaucuggacaaaagaaggagaaagaaagaaacuacgaccccgcuggcuagaugccagaacauacucagacccacuggcccugcgcgaguuuaaagaguuugcagcaggaagaagaagcgucucaggugauuuaauauuagaaauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguugacuggcggagugacgcuguucuuccuaucaggaaggggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucuagccuuggggugcuauucccaagugaauccacugacgcugacagcggcgguacugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaccuugugaaaccagaagggaaagucauagaccucgguuguggaagagguggcuggucauacuauugcgcugggcugaagaaagucacagaagugaagggauacacaaaaggaggaccugggcaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggaacaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaccuggauaucauuggccagaggauagagaacauaaaacaugaacauaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacacuacacccuuuggacaacagaggguguuuaaagagaaaguugacacacgcacaccaaaagcaaaacgaggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagcccgaacaugcccuacuggcuacgucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaauauggcgucgaaaggcuaaaaagaauggcaaucagcggagaugacugcguggugaaaccaauugaugacagguuugcaacagccuuaacagcucugaaugauaugggaaaagugagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuugugggcagggcuagaguaucacaaggugcuggauggagccugagagaaacugcaugccuaggcaagucauaugcacaaauguggcaacugauguacuuccacaggagagaccugagacuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugaucccgaaggggcacucugguga

SEQ ID NO: 5379 - RNA, 9879 nt, Artificial Sequence
  derived and/or modified CDS sequence (wt) from DENV-1__FJ639674__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcaugucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaauuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccauggugcugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguagacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccaguaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgccaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5380 - RNA, 9879 nt, Artificial Sequence
  derived and/or modified CDS sequence (wt) from DENV-1__FJ639675__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaaaugcccucgaaucacugaggcagaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcuuauucaagcuagagaaagaaguggcugagacccagcauggaaccguucuagugcagauuaaauaugaaggaacagaugcaccaugcaagaucccuuuuucgacccaagaugaaaaaggaguaacucagaaugggagacugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaucagauuuuuggaacugcauauggaguuuuguucagcgguguuuccuggaccaugaaaauaggaauagggguucugcugacauggcuaggauuaaacucaaggagcacgucccuuucgaugacgugcauugcaguuggcuuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucaucagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaauuuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaagcuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggagcagaaaaaugcugaugacuggaacacuggcuguguucuuccuucucauaaugggacaauugacauggaaugaucugaucagauuaugcaucaugguuggagccaacgcuuccgacaggauggggaugggaaugacguaccuagcucugauggccacuuuuaaaaugagaccaauguuugcuguaggacuauuauuccgcagacuaacauccagagaaguucuucuucuaacaauuggauugagucuaguggcauccguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcauuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacucuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaagaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagcccuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcucaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuggcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaauucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaaccgcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcgaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaauacuuucaccaacauggaagcccagcugauaagacagauggagucugagggaaucuuuucacccagcgaauuagagaccccaaauuuagccgagagaguucucgacuggcuggaaaaacauggcguugaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugcccuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucagugguguggaucccugauaggcuuaacagcaagggccaccugggccacuaacauacaaguggccauaaaccaagugagaagacuaauugggaaugagaacuaucuagauuacaugacaucaaugaagagauucaagaacgagagugauccugaaggggcacucugguga

SEQ ID NO: 5381 - RNA, 9879 nt, Artificial Sequence
  derived and/or modified CDS sequence (wt) from DENV-1__FJ639676__SS-prME
ucugugaccaugcuccuuaugcugaugccuacagccuuggcguuccauuugacuacacgaggaggagagccgcacaugauaguuagcaagcaggaaagaggaaagucacuuuuguucaagaccucagcaggugucaacaugugcacccuuauagcgauggauuugggagaguuaugugaggacacaaugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgcgggacuugguuuagaaacaagagccgaaacguggauguccucugaaggcgcuuggaaacagauacaaagaguggagacuugggcccugagacacccaggauucacggugauagcccuuuuucuagcacaugucauaggaacauccaucacccagaaagggauuauuuucauuuuguuaaugcugguaacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauuaguggaagaacaagacgcgaacuuugugugccgacgaacguuuguggacagaggcuggggcaauggcugugggcucuucggaaaaggaagcuugauaacgugugcuaaguucaagugugugacaaaacuggaaggaaagauaguucaauaugaaaacuugaaauauucaguaauagucaccguccacacuggggaccagcaccaggugggaaaugaaagcacagaacaugggacaacugcaacuauaacaccucaagcuccuacgucggaaauacagcugaccgacuacggagcucuuacauuggauugcucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaagaaguagucguacuaggaucacaagaaggagcaaugcacacugcguugaccggagcgacagaaauccaaacgucuggaacgacaacaauuuuugcaggacaccugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggagugacccagaaugggagauugauaacagcgaaccccauagucaccgacaaagaaaaaccagucaacauugaggcagaaccgccuuuuggugagaguuacaucgugauuggagcaggugaaaaagcuuugaagcuaagcugguucaagaaaggaagcagcauagggaaaauguuugaggcaaccgccagaggagcacgaaggauggccauacugggagacaccgcaugggacuuugguucuauaggaggaguguucacgucuguuggaaaacuaguacaccagauuuuuggaacagcauauggaguuuuguucagcgguguuuccuggaccaugaaaauaggaauagggguucugcugacauggcuaggauuaaacucaaggagcacgucccuuucgaugacgugcauugcaguugggcuaguaacacuauaccuaggagucaugguucaggcagauucaggauguguaauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcccaaggaaaaaagaugauuaggccacaacccauggaacacaaauacucauggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaacgagaccuggaagcuggcaagagccucuuucauagaaguuaaaacauguaucuggccaaaaucccacacccuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuagaaccacaacagucacaggaaagauaauucaugaaugguguugcagaucuugcacguuaccaccccuacguuuuaaaggagaagauggguguugguacgguauggaaaucagaccagucaaggaaaaggaagagaaucuagucaagucaauggucucugcagggucaggggaaguggacagcuuuucacuaggacuguuaugcauaucaauaaugaucgaagaggugaugagauccagauggaguaggaaaaugcugaugacuggaacacuggcuguguucuuccuucucauagugggacaauuaacauggaaugaucugaucagguuaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucagucauaucagcugugggcuaccuugcuguccuugacauuuaucaaaacgacguuuuccuugcacuaugcauggaagacaauggcuaugguacugucaauuguaucucuccuccccuuaugccuguccacgaccucccaaaagacaacauggcuuccggugcuauugggaucucuuggaugcaaaccacuaacuauguuuuuuauagcagaaaacaaaaucuggggaaggaaaaguuggccccucaaugaaggaaucauggcuguuggcauagucaguauccuacuaaguucacuccucaaaaaugaugugccgcuagcugggccacuaauagcuggaggcaugcuaauagcauguuauguuauaucaggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuucugaaauggcagaggcgcucaaggggaugccaauaagguaccaaacaacagcagugaagagugaacacacaggaagagagauaguugaccuuaugugucacgccacuuucaccaugcgucuccugucuccugugagaguucccaauuacaacaugauuaucauggaugaagcucauuucaccgauccauccagcauagcggccagaggauacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucgucacaacagacaucuccgaaaugggagcaaacuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcccacuggacagaagcaaaaaugcuccuugauaauauaaacacaccagaagggauuaucccagcccucuucgaaccggagagagagaagagugcagcaauagacggggaauacagacugcggggugaagcaaggaaaacguuuguggagcucaugagaagaggagauuuaccugucuggcuauccuacaaaguugccucagaaggcuuccaguacuccgacagaagauggugcuuugacggggaaaggaacaaccagguguuggaggagaacauggacguggagaucuggacaaaagaaggagaaagaaagaaacuacgaccccgcuggcuggaugccagaacauauucagacccacuggcccugcgcgaguuuaaagaguuugcagcaggaagaagaagcaucucaggugauuuaauauuagaaauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguuaacugguggagugacgcuguucuuccuaucaggaaggggccuagggaaaacaucuauaggccuacucugcgugauggcuucaagugcacugcuauggauggccaguguggagccccauuggauagcugccuccaucauacuggaguucuuccugauggugcugcuuauuccagagccagacagacaacgcacuccgcaagacaaccagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucccaggugaauccacugacgcugacagcggcgguacugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuacaaaaggagugggauauuggaaguggacagauccgaagccaaagagggacuaagaagaggagaaacaaccaaacacgcggugucgagaggaacugccaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaccuggauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacgaggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagcccgaacaugcccuacuggcuacgucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaauauggcgucgaaaggcugaaaagaauggcaaucagcggagaugacugcguggugaaaccaauugaugacagguuugcgacagccuuaacagcucugaaugauaugggaaaaguaagaaaagauauuccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagcuugagagaaacugcaugccuaggcaagucauaugcacaaauguggcaacugauguacuuccacaggagagaccugagacuagccgcuaaugcuaucuguucagccguuccaguugauugggucccaaccagccgcaccaccuggucgauccaugcccaucaccaauggaugacaacagaagacauguugucaguguggaauaggguuuggauagaggaaaacccauggauggaggacaaaacccauauauccaguugggaagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuucaugacaucaaugaagagauucaagaacgagagugauaccgaaggggcacucugguga

SEQ ID NO: 5382 - RNA, 9879 nt, Artificial Sequence
  derived and/or modified CDS sequence (wt) from DENV-1__FJ639677__SS-prME
uccgugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgagucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauauucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuugucaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuuggcucaaggaaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaccuagcucugauggccacuuuuaaaaugagaccaauguuugcuauggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuuaaaggauccuggaacacgggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaaggaaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcaguaaagagugaacacacaggaaaagagauaguugaccucaugugucacgccacuuucaccaugcgccuccugucucccgugagaguucccaauuacaacaugauuaucauggaugaagcacauuuuaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcgaggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauaggaguuccacuucucgcuuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggaaccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaagcaagaaaccaagaauuuguacaagagaggaguucauaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccugagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5383 - RNA, 9879 nt, Artificial Sequence
  derived and/or modified CDS sequence (wt) from DENV-1__GQ868618__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaaaugcccucgaaucacugaggcggaaccagaugacguugauuguuggugcaaugccacagacacaugggugacuuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacaucuaucacccagaaagggauuauuuucauuuuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuagacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacugauaacagcuaacccuauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauugguacaccagauuuuuggaacugcauauggaguuuuguucagcgguguuuccuggaccaugaaaauaggaauagggguucugcugacaugguuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauuuacagugguuguaggagauguugcuggaaucuuggcucaagggaaaaaaaugauuaggccacaacccauggaauacaaauacucguggaaaagcuggggaaaggcuaaaaucauaggggcagaugugcagaauacuaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcacuuaggcaaguuggaacuggauuuugauuugugugaggguaccacaguuguuguggaugaacauuguggaaaucgaggaccaucucuuaggaccacaacagucacaggaaagauaauucaugaauggugcugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaaugcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccuccgaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacaucgccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcucaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccguuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuucucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaauugaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagagacaaccaaacaugcagugucgagaggaaccgcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggacacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaauacuuucaccaacauggaagcccagcugauaagacagauggagucugagggaaucuuuucacccagcgaauuagagaccccaaauuuagccgagagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaagaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaucaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5384 - RNA, 9879 nt, Artificial Sequence
  derived and/or modified CDS sequence (wt) from DENV-1__GQ868619__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugccaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuuggcucaaggaaaaaaaaugauuaggccacaacccauggaauauaaauacucguggaaaagcuggggaaaggcuaaaaucauaggggcagaugcacagaacaccaccuucaucaucgacggcccaaacaccccagaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggagagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacugguuguguucuuccuucucauaaugggacaauugacauggaaugaucugaucagauuaugcaucaugguuggagccaacgccuccgacaggauggggaugggaacgacguaccuagcucugauggccacuuuuaaaaugagaccaauguuugcuguggggcugcuauuccgcagauuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacauuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcaugcuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccauacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccccugaaggcgaaguuggagccauugcccuagauuuuaaacccggcacaucuggaucucccaucgugaacagagaaggaaaaauagugggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgucuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaauggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcaaauuuccgggccgacagggugauagacccaagacggugucugaaaccgauaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuauguugcacaacuccgaacaaggaggaagagccuauagacaugcaauggaagaacugccagacaccauagaaacguuaaugcuccuagcuuugauagcuguguuaacugguggagugaugcuguucuuccuaucaggaaggggccuagggaaaacaucuaucggccuacucugcgugauggcuucaagcggacugcuauggauggccaguguggagccccauuggauagcggccuccaucauacuggaguucuuccugauggugcugcuuauuccagagccagacagacaacgcacuccgcaggacaaccagcuggcauauguggugauggguuuguuauucaugauacugacaguagcagccaaugagaugggacugcuggaaaccacaaagaaagacuuagggauuggccauguggcuguugaaaaucaccaccaugccgcaauguuggacguagacuuacauccagcuucagccuggacccucuaugcaguggccacaacaauuaucacucccaugaugaggcacacaaucgaaaacacaacagcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacaggagcccaaggggaaacacugggagagaaauggaaaaggcagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaaggaaacauggaggaaugcuagugcgaaauccacuuucaagaaauucuacccaugaaauguacuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacgguuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccugagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggcuaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5385 - RNA, 9879 nt, Artificial Sequence
  derived and/or modified CDS sequence (wt) from DENV-1__FJ639678__SS-prME
ucugugaccaugcuccuuaugcugaugccuacagccuuggcguuccauuugacuacacgaggaggagagccgcacaugauaguuagcaagcaggaaagaggaaaggcacuuuuguuuaagaccucagcaggugucaacaugugcacccuuauagcaauggauuugggagaguuaugugaggacacaaugacuuacaaguguccucgaauuacugagguggaaccagaugacguugauuguuggugcaaugccacagacacaugggugaccuauggaacaugcccccaaacuggcgagcaccgacgagacagacguuccguugcacuggccccacaugugggacuugguuuggaaacaagagccgaaacguggauguccucugaaggcgcuuggaaacagauacaaagaguggagacuugggcccugagacacccgggauucacggugauagcccuuuuucuagcacaugccauaggaacauccauuacccagaaagggauuauuuucauuuuguuaaugcugguaacaccuuccauggccaugcgaugcgugggaauaggcaacagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaauaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaucaggugggaaaugaaagcacagaacaugggacaaccgcaacuauaacaccucaagcuccuacgucggaaauacagcugaccgacuacggagcucuuacauuggauugcucaccuagaacaggacuagacuucaaugaaaugguguuguugacaaugaaagaaaaaucauggcuaguccacaaacaaugguuucuagaccuaccacugcccuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcagggcaccugaaauguagacuaaagauggacaaacugacucuaaaagggaugucauaugugaugugcacaggaucguuuaagcuagagaaagaaguggcugagacccagcauggaaccguucuagugcagauuaaauacgaaggaacagaugcaccaugcaagauccccuuuucgacccaagaugaaaaaggaguaacccagaaugggagauugauaacagcuaacccuauagucacugacaaagaaaaaccagucaacauugaggcagaaccgccuuuuggugagaguuacaucgugauaggagcaggugaaaaagcuuugaaacuaagcugguucaagaaaggaagcagcauaggaaaaauguuugaggcaacugccagaggagcacgaaggauggccauacugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggguuaaacucaaggagcacgucucuuucgaugacgugcauugcaguuggucuaguaacacuauaccuaggagucaugguucaggcggauucaggauguguaaucaauuggaaagguagagaacucaaauguggaaguggcauuuuugucaccaaugaaguucacacuuggacagaacaauacaaauuucaagcugacuccccaaagagacuaucagcagccaucgggaaggcaugggaggaggguguguguggaauucgaucagccacccgucucgagaauaucauguggaagcaaauaucaaaugaacugaaccacaucuuacuugaaaaugacaugaaauucacagugguuguaggagauguuguugggaucuuggcucaagggaaaaagaugauuaggccacaacccauggaauacaaauacucguggaaaagcuggggaaaggcaaagaucauaggggcagauauacagaacaccaccuucaucaucgacggcccaaacaccccagaaugcccugaugaucaaagagcguggaacauuugggaaguugaggacuauggauuuggaauuuucacgacaaacauauggcugaaauugcgugacuccuacacccaagugugugaccaccggcugaugucagcugccaucaaggacagcaaggcaguucacgcugauaugggguacuggauagaaagugaaaagaacgagaccuggaagcuggcaagagccucuuucauagaaguuaaaacauguaucuggccaaaaucccacacccuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaauagaggaccaucucuuagaaccacaacagucacaggaaagauaauucaugaaugguguugcagaucuuguacgcuaccacccuuacguuucaaaggagaagauggguguugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagguuaugcaucaugguuggagccaacgcuuccgacaggauggggaugggaacgacguaccuagcucugauggccacuuuuaaaaugagaccaauguuugcugucgggcuauuauuccgcagacuaacauccagagaaguucuucuucuaacaauuggauugagucuaguggcaucuguggaguuaccaaauuccuuagaggagcugggggauggacuugcaaugggcauuaugaucuuaaaauuauugacugacuuucagucacaucagcugugggccaccuugcuguccuugacauuuaucaaaacaacguuuuccuugcacuaugcauggaagacaauggcuaugguacugucaauuguaucucuccuccccuuaugccuguccacgaccucccaaaaaacaacauggcuuccggugcuauugggaucucuuggaugcaaaccacuaaccauguuucuuauagcagaaaacaaaaucugggggaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucaggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuggcaguuucaggaguguacccauuaucaauaccagcgacccuuuuuuugugguacuuuuggcagaaaaagaaacagagaucuggaguguuaugggacacaccuagcccuccagaagucgaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagaggcuggaaccgaguugggccagugucaaaaaagaucugaucucauauggaggagguuggaggcuucaaggauccuggaacacgggagaagaagugcaggugauugccguugaaccagggaaaaaccccaaaaauguacaaacagcgccgggcaccuuuaagaccccugagggugaaguuggagccauugcccuagauuuuaaacccggcacaucuggaucucccaucgugaacagagaagggaaaauaguaggucuauauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgucuccucucuccugugagaguucccaacuacaacaugauuaucauggaugaagcacauuucaccgauccauccagcauagcggccagaggauacaucucaacccgagugggcaugggugaagcagcugcgaucuucaugacagccacucccccaggaucaguggaggccuuuccacagagcaaugcaguuauccaagaugaggaaagagacauuccugagaggucauggaacucaggcuaugaguggaucacugacuucccagguaaaacaguuugguuuguuccaagcauuaaaucaggaaaugacauugccaauugcuuaagaaagaaugggaaacgggugauucaauugagcaggaaaaccuuugauacagaguaccaaaaaacaaaaaauaacgacugggacuacguugucacaacagacaucuccgaaaugggagcaaacuuccgggccgacagggugauagacccaagacggugucugaaaccgguaauacuaaaagauggucaagagcgugucauuuuagcaggaccgaugccagugacuguggccagugccgcccagaggagaggaagaauuggaaggaaccacaauaaggaaggugaucaguacaucuacaugggacagccuuuaaacaacgaugaggaucacgcccacuggacagaagcaaaaaugcuccuugauaauauaaacacaccagaagggauuaucccagcccucuucgaaccggagagagaaaaaagugcagcaauagacggggaauacagacugcggggugaagcaaggaaaacguucguggagcucaugagaagaggagaucuaccugucuggcuauccuacaaaguugccucagaaggcuuccaguacuccgacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguucaaagaguuugcagcaggaagaagaagcgucucaggugaucuaauauuggaaauagggaaacuuccacaacacuugacgcaaaaggcccagaaugccuuggacaaccuggucauguugcacaacuccgaacaaggaggaagagccuauagacaugcaauggaagaacugccagacaccauagaaacguugaugcuccuagccuugauagcuguguuaacugguggagugacgcuguucuuccuaucaggaaggggccuagggaaaacaucuaucggccuacucugcgugauggcuucaagcgcacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauuuaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucccaagugaauccacugacgcugacagcagcgguauugaugcuaguggcucauuacgccauaauuggaccuggacuacaagcaaaagcuacuagagaagcucaaaaaaggacagcagccggaauaaugaaaaacccgaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggcuacuggaccucugaccacgcuuugggagggaucuccaggaaaauuuuggaacaccacgauagcagucuccauggcaaacauuuucagaggaaguuaucuagcaggagcaggucuggccuucucauuaaugaaaucucuaggaggagguaggagaggcacgggagcccaaggagaaacauugggagagaaauggaaaagacagcugaaccaacugagcaagucagaauucaacacuuacaaaaggagugggauaauggaaguagauagauccgaagccaaagagggacuaaaaagaggagaaacaaccagacaugcagugucgagaggaaccgccaaacuaaggugguuuguggagaggaaccucgugaaaccagaagggaaaguuauagaccucgguuguggaaggggugguuggucauacuauugcgcugggcugaagaaagucacagaagugaagggauacacaaaaggaggaccuggacaugaggaaccaaucccaauggcaaccuauggauggaaccuaguaaagcugcacuccgggaaagacguauucuucauaccaccugagaaaugugacacccuuuuaugugauauuggugaguccucuccaaacccaacuauagaggaaggaagaacguuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaacccacuuucaagaaauucuacucaugaaauguauuggguuucauguggaacaggaaacauugugucagcaguaaacaugacaucuagaauguugcuaaaucgauucacaauggcucacagaaaaccaacauaugaaagagacguggaccuaggcgccgggacaagacacguggcaguggaaccagagguagccaaccuggacaucauuggccagaggauagagaacauaaaacaugaacauaagucaacauggcauuaugaugaggacaauccauauaaaacaugggccuaucauggaucauaugaagucaagccaucaggaucagccucauccauggucaauggcguggugaaauugcucaccaaaccaugggaugucauccccauggucacacaaauagccaugacugacacuacacccuuuggacaacagaggguguuuaaagagaaaguugacacacgcacaccaaaagcaaaacaaggcacagcacaaaucauggaggugacagccaggugguuaugggguuuucuuucuagaaacaaaaaaccaagaauuuguacaagagaggaguucacaagaaaaguuaggucaaacgcagccauuggagcaguguucguugaugaaaaucaauggaacucagcaaaagaagcaguggaagaugaacgguucugggaucuugugcacagagagagggagcuucauaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuacacaaacucggauauauacucagagacauaucaaagauuccugggggaaacauguaugcagaugacacagccggaugggauacaaggauaacagaggaugaccuucggaaugaggccaaaauuacugacaucauggagcccgaacaugcccuacuggcuacgucaaucuucaagcugaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcuaauaagacaaauggagucugagggaaucuuuucacccagcgaauuggagaccccaaauuuagccgagagaguucucgacuggcuggaaaaauauggcgucgaaaggcugaaaagaauggcaaucagcggagaugacugcguggugaaaccaauugaugacagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagcuugagagaaacugcaugccuaggcaagucauaugcacaaauguggcaacugauguacuuccacaggagagaccugagacuagccgccaaugcuaucuguucagccguuccaguugauugggucccaaccagccgcaccaccuggucgauccaugcccaucaccaauggaugacaacggaagacauguugucaguguggaacaggguuuggauagaggaaaacccauggauggaggacaaaacccauauauccaguugggaagauguuccauacuuaggaaaaagggaagaucagugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5386 - RNA, 9879 nt, Artificial Sequence
  derived and/or modified CDS sequence (wt) from DENV-1__FJ639679__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguuggguaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcuguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguacugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgcgagaguucucgacuggcuggaaaaauauggcgucgaaaggcugaaaagaauggcaaucagcggagaugacugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5387 - RNA, 9879 nt, Artificial Sequence
  derived and/or modified CDS sequence (wt) from DENV-1__FJ850069__SS-prME
ucugugaccaugcuccuuaugcugaugccuacagccuuggcguuccauuugacuacacgaggaggagagccgcacaugauaguuggcaagcaggaaagaggaaagucacuuuuguucaagaccucagcaggugucaacaugugcacccuuauagcgauggauuugggagaguuaugugaggacacaaugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaagaguggagacuugggcccugagacacccaggauucacggugauagcccuuuuucuagcacaugucauaggaacauccaucacccagaaagggauuauuuucauuuuguuaaugcugguaacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauuaguggaagaacaagacgcgaacuuugugugccgacgaacguuuguggacagaggcuggggcaauggcugugggcucuucggaaaaggaagccugauaacgugugcuaaguucaagugugugacaaaacuggaaggaaagauaguucaauaugaaaacuugaaauauucaguaauagucaccguccacacuggggaccagcaccaggugggaaaugaaagcacagaacaugggacaacugcaacuauaacaccucaagcuccuacgucggaaauacagcugaccgacuacggagcucuuacauuggauugcucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacaccugaaauguagacuaaagauggacaaacugacucuaaaagggaugucauaugugaugugcacaggcucauucaagcuagagaaagaaguggcugagacccagcauggaaccguucuagugcagauuaaauaugaaggaacagacgcaccaugcaagaucccuuuuucgacccaagaugaaaaaggaguaacccagaaugggagauugauaacagcuaaccccauagucacugacaaagaaaaaccagucaacauugaggcagaaccgccuuuuggugagaguuacaucgugauuggagcaggugaaaaagcuuugaagcuaagcugguucaagaaaggaagcagcauagggaaaauguuugaggcaaccgccagaggagcacgaaggauggccauacugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguuuugcugacauggcuaggauuaaacucaaggagcacgucccuuucgaugacgugcauugcaguuggucuaguaacacuauaccuaggagucaugguucaggcagauucaggauguguaauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgauccgccacccgucucgagaauaucauguggaggcaaauaucaaaugaacugaaccacaucuuacuugaaaaugacaugaaauucacaguaguuguaggagauguuguugggaucuuggcccaaggaaaaaagaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaacauauggcugaaauugcgugacuccuacacccaagugugugaccaccggcugaugucagcugccaucaaggacagcaaggcaguucacgcugauaugggguacuggauagaaagugaaaagaacgagaccuggaagcuagcaagagccucuuucauagaaguuaaaacauguaucuggccaaaaucccacacccuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuagaaccacaacagucacaggaaagauaauucacgaaugguguugcagaucuugcacguuaccacccuuacguuuuaaaggagaagaugggugcugguacgguauggaaaucagaccagucaaggaaaaggaagagaaucuagucaaaucaauggucucugcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucagguuaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcuguggguuaccuugcuguccuugacauuuaucaaaacaacguuuuccuugcacuaugcauggaagacaauggcuaugguacugucaauuguaucccuccuccccuuaugccuguccacgaccucccaaaagacaacauggcuuccggugcuauugggaucucuuggaugcaaaccacuaacuauguuuuuuauagcagaaaacaaaaucuggggaaggaaaaguuggccccucaaugaaggaaucauggcuguuggcauagucaguauccuacuaaguucacuccucaaaaaugaugugccgcuagcugggccacuaauagcuggaggcaugcuaauagcauguuauguuauaucaggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacuuugcuagcaguuucagggguguacccauuaucaauaccagcgacccuuuuugugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuucaaacccggcacaucugguucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaccuuaugugucacgccacuuucaccaugcgucuccugucuccugugagaguucccaauuacaacaugauuaucauggaugaagcacauuucacugauccauccagcauagcggccagaggauacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcaucaaaucaggaaaugacauugccaacugccuaagaaagaaugggaaacgggugauucaauugagcagaaaaaccuuugauacagaguaccaaaaaacaaaaaauaacgacugggacuacgucgucacaacagacaucuccgaaaugggagcaaacuuccgggccgacagggugauagacccaagacggugucugaaaccgguaauacuaaaagaugguccagagcgugucauuuuagcaggaccgaugccagugacuguggccagugccgcccagaggagaggaagaaucggaaggaaccacaauaaggaaggugaucaguacaucuacaugggacagccuuuaaacaacgaugaagaucacgcccacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucuggcuauccuacaaaguugccucagaaggcuuucaguacuccgacagaagauggugcuuugacggggaaaggaacaaccagguguuggaggagaacauggacguggagaucuggacaaaagaaggagaaagaaagaaacuacgaccccgcuggcuggaugccagaacauauucagacccacuggcccuacgcgaguuuaaagaguuugcagcaggaagaagaagcaucucaggugauuuaauauuagaaauagggaaacuuccacaacacuugacgcaaagggcccagaaugccuuggauaaccuggucauguugcacaacuccgaacaaggaggaagagccuauagacaugcaauggaagaacugccagacacuauagaaacguugaugcuccuagcuuugauagcuguguuaacugguggagugacgcuguucuuccuaucaggaaggggccuagggaaaacaucuaucggccuacucugcgugauggcuucaagugcacugcuauggauggccaguguggagccccauuggauagcggccuccaucauacuggaguucuuccugaugguguugcuuauuccagagccagacagacaacgcacuccgcaagacaaccagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccuaacagcuauugcgaaccaggcagcuauauugaugggacuugauaaaggauggccaauaucgaagauggacauaggaguuccacuucucgccuuggggugcuauucccaagugaauccacugacgcugacagcggcgguauugaugcuaguggcucauuacgccauaauuggaccuggacugcaagcaaaagcuacuagagaagcccaaaaaagaacagcggccggaauaaugaaaaauccaaccguugauggaauuguugcaauagauuuggauccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuacaaaaggagugggauauuggaaguggacagauccgaagccaaagagggacuaagaagaggagaaacaaccaaacaugcggugucgagaggaacugccaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaccuggauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacgaggcacugcacaaaucauggaggugacagccgggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuuuaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagcccgaacaugcccuacuggcuacgucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaauauggcgucgaaaggcugaaaagaauggcaaucagcggagaugacugcguggugaaaccaauugaugacagguuugcgacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaacugauguacuuccacaggagagaccugagacuagccgcuaaugcuaucuguucagccguuccaguugauugggucccaaccagccgcaccaccuggucgauccaugcccaucaccaauggaugacaacagaagacauguugucaguguggaauaggguuuggauagaggaaaacccauggauggaggacaaaacccauauauccaguugggaagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugauaccgaaggggcacucugguga

SEQ ID NO: 5388 - RNA, 9879 nt, Artificial Sequence
  derived and/or modified CDS sequence (wt) from DENV-1__FJ639680__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauauucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuugucaccaaugaaguucauacuuggacagagcaauacaaauuucaagcugauuccccaaagagacuaucagcagccauugggaaggcaugggaggaagguguguguggaauucgaucagcaacucgucucgagaacaucauguggaaacaaauaucaaaugaauugaaccacaucuuacuugaaaaugacaugaaacucacagugguuguaggagauguugcugggaucuuggcucaaggaaagaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaccuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcucuccuugacauuuaucaaaacaacauuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaaggaaaaauaguaggucuuuauggaaauggaguagugacaacaaguggaaccuacgucagugccauagcucaagcuaaagcaucacaagaagggccccuaccagagauugaagacgagguguuuaggaaaagaaauuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucguuacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcgaggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauauugacaguagcagccaaugagaugggacugcuagaaaccacaaagaaagacuuagggauuggccauguggcuguugaaaaucacaaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauaggaguuccacuucucgcuuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugaccgacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugacugcguagugaaaccaauugaugauagguuugcaacagccuuaacagcucugaaugauaugggaaaagugagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccugagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5389 - RNA, 9879 nt, Artificial Sequence
  derived and/or modified CDS sequence (wt) from DENV-1__FJ639682__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgaacaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauauucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuggagaaagaaguggcugagacccagcauggaaccguucuagugcagauuaaauacgaaggaacagaugcaccaugcaagaucccuuuuucgacccaagaugagaaaggaguaacccagaaugggagauugauaacagccaaccccauagucacugacaaagaaaaaccagucaacauugaggcagaaccgccuuuuggugagaguuacaucgugauaggagcgggugaaaaaacuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucuacugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuugucaccaaugaaguucauacuuggacagagcaauacaaauuucaagcugauuccccaaagagacuaucagcagccauugggaaggcaugggaggaagguguguguggaauucgaucagcaacucgucucgagaacaucauguggaagcaaauaucaaaugaauugaaccacaucuuacuugaaaaugacaugaaacucacagugguuguaggagauguugcugggaucuuggcucaaggaaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaucggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggaguaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguaugguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaccuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacauuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuuuaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggcgaaguuggagccauugcccuagauuuuaaacccggcacaucuggaucucccaucgugaacagagaaggaaaaauaguaggucuuuauggaaauggaguagugacaacaaguggaaccuacgucagugccauagcucaagcuaaagcaucacaagaagggccccuaccagagauugaagacgagguguuuaggaaaagaaauuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaucccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuaccgauccauccagcauagcggccagaggguacaucucaacccgagugggcaugggugaagcagccgcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcaaauuuccgggccgacagggugauagauccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcgaggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugcccuggacaaccugguuaugcugcacaauuccgaacaaggaggaagagccuauagacaugcaauggaagaauugccagacaccauagaaacguuaaugcuccuagccuugauagcuguguuaacugguggagugacgcuguucuuccuaucaggaaggggccuagggaaaacaucuaucggccuacucugcgugauggcuucaagcguacugcuauggauggccagcguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuagaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauaggaguuccacuucucgcuuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcgucuuaaagaugguggaaccauggcucagaggaaaccaauuuugcauaaaaauucugaaucccuacaugccaagugugguggaaacucuggagcaaaugcaaagaaaacauggaggaaugcuagugcgaaauccccuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugacuguguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccugagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5390 - RNA, 9879 nt, Artificial Sequence
  derived and/or modified CDS sequence (wt) from DENV-1__JQ287664__SS-prME
ucugugaccaugcuccuuaugcugaugccuacagccuuggcguuccauuuaacuacacgaggaggagagccgcacaugauaguuagcaagcaggaaagaggaaagucacuuuuguucaagaccucagcaggugucaacaugugcacccuuauagcgauggauuugggagaguuaugugaggacacaaugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaagaguggagacuugggcccugagacacccaggauucacggugauagcccuuuuucuagcacaugucauaggaacauccaucacccagaaagggauuauuuucauuuuguuaaugcugguaacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacaucgaacucuugaagacggaagucacaaacccugccguccugcgcaaacugugcauugaagcuaaaauaucaaacaccaccaccgacucaagauguccaacacaaggagaagccacauuaguggaagaacaagacgcgaacuuugugugccgacgaacguuuguggacagaggcuggggcaauggcugugggcucuucggaaaaggaagccugauaacgugugcuaaguucaagugugugacaaaacuggaaggaaagauaguucaauaugaaaacuugaaauauucaguaauagucaccguccacacuggggaccagcaccaggugggaaaugaaagcacagaacaugggacaaccgcaacuauaacaccucaagcuccuacgucggaaauacagcugaccgacuacggagcucuuacauuggauugcucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacaccugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccauguaagaucccuuuuucgacccaagaugaaaaaggaguaacccagaaugggagauugauaacagcuaaccccauagucaccgacaaagaaaaaccagucaacauugaggcagaaccgccuuuuggugagaguuacaucgugauuggagcaggugaaaaagcuuugaagcuaagcugguucaagaaaggaagcagcauagggaaaauguuugaggcaaccgccagaggagcacgaaggauggccauacugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacacuauaccuaggagucaugguucaggcagauucaggauguguaauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccauuaaggacagcaaggcaguucacgcugauaugggguacuggauagaaagugaaaagaacgagaccuggaagcuggcaagagccucuuucauagaaguuaaaacauguaucuggccaaaaucccacacccuauggagcaacggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuagaaccacaacagucacaggaaagauaauccaugaaugguguugcagaucuugcacguuaccacccuuacguuuuaaaggagaagauggguguugguacgguauggaaaucagaccagucaaggaaaaggaagagaaucuagucaaaucaauggucucugcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucagguuaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucagucauaucagcugugggcuaccuugcuauccuugacauuuaucaaaacaacguuuuccuugcacuaugcauggaagacaauggcuaugguacugucaauuguaucgcuccuccccuuaugccuguccacgaccucccaaaagacaacauggcuuccgguacuacugggaucucuuggaugcaaaccacuaaccauguuuuuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcugauagcauguuauguuauaucaggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccauacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaaaauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaccuuaugugucacgccacuuucaccaugcgucuccugucuccugugagaguucccaauuacaacaugauuaucauggaugaagcucauuucaccgauccauccagcauagcggccagaggauacauuucaacccgagugggcaugggugaagcagcugcgaucuucaugacagccacucccccaggaucaguggaggccuuuccacagagcaaugcaguuauccaagaugaggaaagagacauuccugagagaucauggaacucaggcuaugaguggaucacugacuucccaggcaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucgucacaacagacaucuccgaaaugggagcaaacuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcccacuggacagaagcaaaaaugcuccuugauaacauaaacacaccagaagggauuaucccagcccucuucgaaccggagagagaaaagagugcagcaauagacggggaauacagacugcggggugaagcaaggaaaacguuuguggagcucaugagaagaggagaucuaccugucuggcuauccuacaaaguugccucagaaggcuuccaguauuccgacagaagauggugcuuugacggggaaaggaacaaccagguguuggaggagaacauggacguggagaucuggacaaaagaaggagaaagaaagaaacuacgaccccgcuggcuggaugccagaacauauucagacccacuggcccugcgcgaguuuaaagaguuugcagcaggaagaagaagcaucucaggugauuuaauauuagaaauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguuaacugguggagugacgcuguucuuccuaucaggaaggggccuagggaaaacaucuaucggcuuacuuugcgugauggcuucaagugcacugcuauggauggcuaguguggagccccauuggauagcggccuccaucauacuggaguucuuucugauggugcugcuuauuccagagccagacagacaacgcacuccgcaagacaaccagcuggcauauguggugauagguuuguuauucaugauacugacaguagcagccaaugagaugggauuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuacaaaaggagugggauauuggaaguggacagauccgaagccaaagagggacuaagaagaggagaaacaaccaaacaugcggugucgagaggaacugccaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaaguugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacuuuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaccuggauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacgaggcacugcacaaaucauggagguuacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagcccgaacaugcccuacuggcuacgucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaauauggcgucgaaaggcugaaaagaauggcaaucagcggagaugacugcguggugaaaccaauugaugacagguuugcgacagccuuaacagcucugaaugauaugggaaaaguaagaaaagauauaccacaaugggaaccuucaaaaggauggaaugauuggcaacaagugccuuucuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaacugauguacuuccacaggagagaccugagacuagccgcuaaugcuaucuguucagccguuccauuugauugggucccaaccagccgcaccaccuggucgauccaugcccaucaccaauggaugacaacagaagacauguugucaguguggaauaggguuuggauagaggaaaacccauggauggaggacaaaacccauauauccaguugggaagauguuccauauuuaggaaaaagggaagaucagugguguggaucucugauaggcuuaacagcaagggccaccugggccaccaacauacaaguggccauaaaccaagugagaagauuaauugggaaugagaauuauuuagauuacaugacaucaaugaagagauuuaagaacgagagugauaccgaaggggcacucugguga

SEQ ID NO: 5391 - RNA, 9879 nt, Artificial Sequence
  derived and/or modified CDS sequence (wt) from DENV-1__FJ639683__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcauuggccccacacgugggacuugguuuggaaacaagaaccgaaacguggauguccucugaaggcgcuuggaaacagauacaaagaguggagacuugggcccugagacacccaggauucacggugauagcccucuuucuagcacaugccauaggaacauccaucacucagaaagggauuauuuucauuuuguuaaugcugguaacaccauccauggcuaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagcuuaauaacgugugcuaaguucaagugugugacaaaacuggaaggaaagauaguucaauaugaaaacuugaaauauucaguaauaguuaccguucacaccggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacguccuuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucauuggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuccuaacaauuggauugagucuaguggcaucuguggaguugccaaauuccuuggaggagcugggggauggacuugcaaugggcauuaugauuuuaaaauuauugacugacuuucaaucacaucagcugugggcuaccuugcuguccuugacauucaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugccuuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaaaggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggccaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccuacgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuguaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagguuugcaacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagauuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5392 - RNA, 9879 nt, Artificial Sequence
  derived and/or modified CDS sequence (wt) from DENV-1__FJ639684__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaaaugcccucgaaucucugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguagaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacgucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauuccuuuuucgacccaagaugaaaaaggaguaacucagaauggaagacugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggcuuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacauuuuacuugaaaaugacaugaaauucacagugguuguaggagauguugcuggaauuuuggcucaaggaaaaaaaaugauuaggccacaacccauggaauacaaguacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacgaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaagcuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaaugacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauucuaaaauuauugacugacuuucaaucacaucaguugugggccaccuugcuguccuugacauuuaucaaaacaacguuuuccuugcacuaugcauggaagacaauggccaugguacugucaauuguaucucucuuucccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacugauagccggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagagaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcucaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuggcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaauucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaauagaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaaccgcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuuuguaccacccgagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaagcauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguagcaguggaaccagagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugcgccacguguguuuacaacaugauggggaagagagagaaaaaacuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuucagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaauacuuucaccaacauggaagcccagcugauaagacagauggagucugaaggaaucuuuucacccagcgaauuagagaccccaaauuuagccgagagagcucucgacuggcuggaaaaacauggcguugaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucuauccaugcccaucaccaauggaugacaacagaagacaugcugucaguguggaauaggguuuggauagaggaaaacccauggauggaggacaaaacccauauauccaguugggaagauguuccauauuuaggaaaaagggaagaucagugguguggaucccugauaggcuuaacagcaagggccaccugggccacuaacauacaaguggccauaaaccaagugagaaggcuaauugggaaugagaauuaucuagauuacaugacaucaaugaagagauucaagaacgagaguguuccugaaggggcacucugguga

SEQ ID NO: 5393 - RNA, 9879 nt, Artificial Sequence
  derived and/or modified CDS sequence (wt) from DENV-1__FJ639685__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugaccuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccucuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagcuuaauaacgugugcuaaguucaagugugugacaaaacuggaaggaaagauaguucaauaugaaaacuugaaauauucaguaauaguuaccguucacaccggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcaacagaaauucaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauagucacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacguccuuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacaccuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccaguuaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuccuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauucaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugccuuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaaaggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccuacgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcugcuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucaguaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuguaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugagggaaucuuuucacccagcgaauuagagaccccaauuuuagccgagagaguucucgacuggcuggaaaaauauggcgucgaaaggcugaaaagaauggcaaucagcggagaugacugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuaguggguagggcuagaguaucacaaggugcuggauggagccugagagaaacugcaugccuaggcaagucauaugcacagauguggcagcugauguacuuccacaggagagaccugagauuagccgcuaaugcuaucuguucagccguuccaguugauuggaucccaaccagccgcaccaccuggucgauccaugcccaucaccaauggaugacaacagaagacaugcugucaguauggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucgaugaagagauucaagaacgagagugaucccgaaggggcacucugguga

SEQ ID NO: 5394 - RNA, 9879 nt, Artificial Sequence
  derived and/or modified CDS sequence (wt) from DENV-1__FJ639686__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaagcugaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccucuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagcuuaauaacgugugcuaaguucaagugugugacaaaacuggaaggaaagauaguucaauaugaaaacuugaaauauucaguaauaguuaccguucacaccggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacuuuaaaagggaugucauaugugaugugcacaggcucauucaagcuagagaaagaaguggcugagacccagcauggaaccguucuagugcagauuagauaugaaggaacagaugcaccaugcaagaucccuuuuucgacccaagaugaaagaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacguccuuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggagaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaagaugcugaugacuggaacacuggcuguguuccuccuucucauaaugggacaauugacauggaaugaucugaucagacuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuccuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauucaucaaaacaacguuuuccuugcacuaugcauggaagacaauggcuaugguacugucaauuguaucucucuuucccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggagaaguuggagccauugccuuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaaaggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccuacgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuggggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggaccccgugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaauaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuguaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucauaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggacgucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagauuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5395 - RNA, 9879 nt, Artificial Sequence
  derived and/or modified CDS sequence (wt) from DENV-1__FJ639687__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaaaugcccucgaaucucugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggcaaugcgaugugugggaauaggcagcagggacuucguagaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguagaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacggaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacgucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauuccuuuuucgacccaagaugaaaaaggaguaacucagaauggaagacugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagauaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggcuuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacauuuuacuugaaaaugacaugaaauucacagugguuguaggagauguugcuggaauuuuggcucaagggaaaaaaaugauuaggccacaacccauggaauacaaguacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacgaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaagcuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaaugacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauucuaaaauuauugacugacuuucaaucacaucaguugugggccaccuugcuguccuugacauuuaucaaaacaacguuuuccuugcacuaugcauggaagacaauggccaugguacugucaauuguaucucucuuucccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacugauagccggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagagaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggaacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucagcggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgagugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcucaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuggcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaauucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaauagaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaaccgcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuuuguaccacccgagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaagcauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguagcaguggaaccagagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacaccacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugcgccacguguguuuacaacaugauggggaagagagagaaaaaacuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuucagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauaucuagacgugaccagagaggaaguggccaggucggaacuuauggcuuaaauacuuucaccaacauggaagcccagcugauaagacagauggagucugaaggaaucuuuucacccagcgaauuagagaccccaaauuuagccgagagagcucucgacuggcuggaaaaacauggcguugaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugaaagaaacugcaugccuaggcaagucauaugcacaaauguggcagcugauguacuuccacaggagagaccugagacuagccgcuaaugcuaucuguucagccguuccaguugauugggucccaaccagccgcaccaccuggucuauccaugcccaucaccaauggaugacaacagaagacaugcugucaguguggaauaggguuuggauagaggaaaacccauggauggaggacaaaacccauauauccaguugggaagauguuccauauuuaggaaaaagggaagaucagugguguggaucccugauaggcuuaacagcaagggccaccugggccacuaacauacaaguggccauaaaccaagugagaaggcuaauugggaaugagaauuaucuagauuacaugacaucaaugaagagauucaagaacgagagugauccugaaggggcacucugguga

SEQ ID NO: 5396 - RNA, 9879 nt, Artificial Sequence
  derived and/or modified CDS sequence (wt) from DENV-1__FJ639688__SS-prME
ucugugaccaugcuccuuaugcugaugccuacagccuuggcguuccauuugacuacacgagggggagagccgcacaugauagucagcaagcaggaaagaggaaagucacucuuguucaagaccucagcaggugucaacaugugcacccuuauagcgauggauuugggagaguuaugugaggauacaaugacuuauaaaugcccucgaaucacugaagcugaaccagaugacguugauuguugguguaaugccacagacacaugggugaccuauggaacaugcucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguucguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaagugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacacagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccagucaacauugaggcagaaccgccuuuuggugagaguuacauuguaauaggggcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucauacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacguuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcacuuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagacgggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggacugagucuaguggcaucuguggaguuaccaacuuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcuuccggugcuauugggaucccuuggaugcaaaccacuaaccauguuucucauagcagaaaacaaaaucuggggaaggagaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuucuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugauggcaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccuuaugugucacgccacuuucacuaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaagguugccucagaaggcuuccaguacucugacagaagauggugcuuugacggagaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugaucuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacauuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcugcugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaggagggauugaaaagaggagaaacaaccaaacaugcagugucgaggggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucuggaaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaguuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccaugguuacacaaauggccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaaggaaaguuaggucaaacgcagccauuggagcaguguucguugaugaaaaucaauggaacucagcaaaagaagcaguggaagaugagcgguuuugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggacacaaggauaacagaggaugaccuucagaaugaggccagaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggucaggucggaacuuauggcuugaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuauuuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaauggugcggaucccugauaggcuuaacagcaagggccaccugggccaccaacauacaaguggccauauaccaagugagaagacuaauugggaaugagaauuaucuagauuacaugacaucaaugaagagauucaagaacgagagugaucccgaaggggcacucugguga

SEQ ID NO: 5397 - RNA, 9879 nt, Artificial Sequence
  derived and/or modified CDS sequence (wt) from DENV-1__FJ639689__SS-prME
ucugugaccaugcuccuuaugcugaugccuacagccuuggcguuccauuugacuauacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaagcugaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccucuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagcuuaauaacgugugcuaaguucaagugugugacaaaacuggaaggaaagauaguucaauaugaaaacuugaaauauucaguaauaguuaccguucacaccggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacguccuuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaaaagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagucguuguaggagauguugcugggaucuuggcucaaggaaagaaaaugauuaggccacaacccauggaauacaaauacucguggagaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacaugugucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaccgaagaggugaugagauccagauggaguagaaagaugcugaugacuggaacacuggcuguguuccuccuucucauaaugggacaauugacauggaaugaucugaucagacuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuccuaacaguuggauugagucuaguggcaucuguggaguuaccaaauuccuuggaggagcugggggauggacuugcaaugggcauuaugauuuuaaaauuauugacugacuuucaaccacaucagcugugggcuaccuugcuguccuugacauucaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggagucaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaggcaacucugcuagcaguuucagggguguacccauuaucaauaccagcgacucuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccaggaaaaaaccccaaaaaugugcaaacagcgccgggcaccuuuaagaccccugaaggugaaguuggagccauugccuuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaaaggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggauuacugacuucccaggcaaaacaguuugguuuguuccaagcauuaaaucaggaaaugacauagccaacugcuuaagaaagaaugggaaacgggugauucaauugaguaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguagccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccuacgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaauaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuguaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagauuagccgcuaaugcuaucuguucagccguuccaguugauuggauuccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5398 - RNA, 9879 nt, Artificial Sequence
  derived and/or modified CDS sequence (wt) from DENV-1__FJ639690__SS-prME
ucugugaccaugcuccuuaugcugaugccuacagccuuggcguuccauuugacuauacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaagcugaaccagaugacguugauuguuggugcaaugccacagacacaugggugaccuauggaacauguucccaaauuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccucuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagcuuaauaacgugugcuaaguucaagugugugacaaaacuggaaggaaagauaguucaauaugaaaacuugaaauauucaguaauaguuaccguucacaccggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacguccuuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagucguuguaggagauguugcugggaucuuggcucaaggaaagaaaaugauuaggccacaacccauggaauacaaauacucguggagaagcuggggaaaggccaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccauuaaggacagcaaggcaguucacgcugacaugggguacuggauagaaagugaaaagaacgagaccuggaagcuggcaagagccucuuucauagaagucaaaacaugugucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaccgaagaggugaugagauccagauggaguagaaagaugcugaugacuggaacacuggcuguguuccuccuucucauaaugggacaauugacauggaaugaucugaucagacuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuccuaacaguuggauugagucuaguggcaucuguggaguuaccaaauuccuuggaggagcugggggauggacuugcaaugggcauuaugauuuuaaaauuauugacugacuuucaaccacaucagcugugggcuaccuugcuguccuugacauucaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacucuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccaggaaaaaaccccaaaaaugugcaaacagcgccgggcaccuuuaagaccccugaaggugaaguuggagccauugccuuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaaaggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggauuacugacuucccaggcaaaacaguuugguuuguuccaagcauuaaaucaggaaaugacauagccaacugcuuaagaaagaaugggaaacgggugauucaauugaguaggaaaacuuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguagccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccuacgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaauaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuguaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaucuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuuguacauagagagagggagcuucacaaacagggaaaaugugccacguguguuuacaacaugauggggaagagagagaagaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagauuagccgcuaaugcuaucuguucagccguuccaguugauuggauuccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5399 - RNA, 9879 nt, Artificial Sequence
  derived and/or modified CDS sequence (wt) from DENV-1__FJ639691__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaaaugcccucgaaucucugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggcaaugcgaugugugggaauaggcagcagggacuucguagaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguagaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacgucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauuccuuuuucgacccaagaugaaaaaggaguaacucagaauggaagacugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagauaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggcuuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacauuuuacuugaaaaugacaugaaauucacagugguuguaggagauguugcuggaauuuuggcucaagggaaaaaaaugauuaggccacaacccauggaauacaaguacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacgaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaagcuggaacuggauuuugauuugugugaagguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaaugacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauucuaaaauuauugacugacuuucaaucauaucaguugugggccaccuugcuguccuugacauuuaucaaaacaacguuuuccuugcacuaugcauggaagacaauggccaugguacugucaauuguaucucucuuucccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacugauagccggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagagaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggaacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcucaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuggcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaauucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaauagaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaacugcuaaacugaggugguuuguggagaggaaucuugugaaaccagaagggaaagucauagaccucgguuguggaagagguggcuggucauacuauugcgccggguugaagaaagucacagaagugaagggauacacaaaaggaggaccuggacaugaggagccaauuccaauggcgaccuauggauggaaccuaguaaaacugcacuccgggaaagacguauucuuuguaccacccgagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaagcauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguagaccuaggcgccggaacaagacauguagcaguggaaccagagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcgaaagaagcaguggaagaugagcgguucugggaccuugugcacagagagagggagcuucacaaacagggaaaaugcgccacguguguuuacaacaugauggggaagagagagaaaaaacuaggagaguucggaaaggcaaaaggaagucgugcaauaugguacaugugguugggagcacgcuuucuagaguucgaagcucuugguuucaugaaugaagaucacugguucagcagagagaauucacucagcggaguggaaggagaaggacuccacaaacuuggauauauacucagagacauaucaaagauuucagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauaucuagacgugaccagagaggaaguggccaggucggaacuuauggcuuaaauacuuucaccaacauggaagcccagcugauaagacagauggagucugaaggaaucuucucacccagcgaauuagagaccccaaauuuagccgagagaacucucgacuggcuggaaaaacauggcguugaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucuauccaugcccaucaccaauggaugacaacagaagacaugcugucaguguggaauaggguuuggauagaggaaaacccauggauggaggacaaaacccauauauccaguugggaagauguuccauauuuaggaaaaagggaagaucaaugguguggaucccugauaggcuuaacagcaagggccaccugggccacuaacauacaaguggccauaaaccaagugagaaggcuaauugggaaugagaauuaucuagauuacaugacaucaaugaagagauucaagaacgagagugaucuugaaggggcacucugguga

SEQ ID NO: 5400 - RNA, 9879 nt, Artificial Sequence
  derived and/or modified CDS sequence (wt) from DENV-1__FJ639692__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauugcgauggauuugggagaguuaugugaggacacaaugacuuacaaaugcccucgaaucacugaagccgaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaagcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaauuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacuucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaaacuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcugucuuugacauucaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaacuauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcacuaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcagaaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccucgcuggcuggaugccagaacauacucagacccacuagcccugcgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuugcauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugacgggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuacggaaguggacagauccgaagccaaagagggauugaaaagaggagaaacaaccaaacaugcagugucgagaggaaccgcuaaacugaggugguuuguggagaggaaccuugugaaaccagaagggaaagucauagaccuugguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguguucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggucagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaauaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaaacuaggagaguucggaaaggcaaaaggaagucgugcaauaugguacaugugguugggagcacgcuuucuagaguucgaagcucuugguuucaugaacgaagaucacugguucagcagggagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagauuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5401 - RNA, 9879 nt, Artificial Sequence
  derived and/or modified CDS sequence (wt) from DENV-1__FJ639693__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaaaugcccucgaaucucugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggcaaugcgaugugugggaauaggcagcagggacuucguagaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguagaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccauaaacaaugguuucuagaccuaccacugccuuggaccucgggagcuucaacgucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauaugugaugugcacaggcucauucaagcuagagaaagaaguggcugagacccagcauggaaccguucuagugcagauuaaauaugaaggaacagaugcaccaugcaagauuccuuuuucgacccaagaugaaaaaggaguaacucagaauggaagacugauaacagcuaaccccauagucacugacaaagaaaaaccaguuaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagauaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggcuuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacauuuuacuugaaaaugacaugaaauucacagugguuguaggagauguugcuggaauuuuggcucaaggaaaaaaaaugauuaggccacaacccauggaauacaaguacucguggaaaagcuggggaaaggcuaaaaucauaggggcagaugugcagaauaccaccuucaucaucgacggcccgaacaccccagaaugcccugaugaccaaagagcauggaacauuugggaaguugaggacuauggauuuggaauuuucacgacgaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaagcuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuucugacagaauggggaugggaaugacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauucuaaaauuauugacugacuuucaaucacaucaguugugggccaccuugcuguccuugacauuuaucaaaacaacguuuuccuugcacuaugcauggaagacaauggccaugguacugucaauuguaucucucuuucccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacugauagccggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagagaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggaacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucagcggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcucaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuggcuuugauagcuguguuaacugguggagugacguuguucuuccuaucaggaaggggccuagggaaaacaucuaucggccuacucugcgugauggcuucaagcguacugcuauggauggccaguguggagccccauuggauagcggccuccaucauacuggaauucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaauagaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuggccgucggauuucagaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaaccgcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuuuguaccacccgagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaagcauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguagcaguggaaccagagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacaccacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugcgccacguguguuuacaacaugauggggaagagagagaaaaaacuaggagaguucggaaaggcgaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuucagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauaucuagacgugaccagagaggaaguggccaggucggaacuuauggcuuaaauacuuucaccaacauggaagcccagcugauaagacagauggagucugaaggaaucuuuucacccagcgaauuagagaccccaaauuuagccgagagagcucucgacuggcuggaaaaacauggcguugaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagggaaacugcaugccuaggcaagucauaugcacaaauguggcagcugauguacuuccacaggagagaccugagacuagccgcuaaugcuaucuguucagccgguccaguugauugggucccaaccagccgcaccaccuggucuauccaugcccaucaccaauggaugacaacagaagacaugcugucaguguggaauaggguuuggauagaggaaaacccauggauggaggacaaaacccauauauccaguugggaagauguuccauauuuaggaaaaagggaagaucagugguguggaucccugauaggcuuaacagcaagggccaccugggccacuaacauacaaguggccauaaaccaagugagaaggcuaauugggaaugagaauuaucuagauuacaugacaucaaugaagagauucaagaacgagagugauccugaaggggcacucugguga

SEQ ID NO: 5402 - RNA, 9879 nt, Artificial Sequence
  derived and/or modified CDS sequence (wt) from DENV-1__FJ639694__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaagcugaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccucuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagcuuaauaacgugugcuaaguucaagugugugacaaaacuggaaggaaagauaguucaauaugaaaacuugaaauauucaguaauaguuacuguucacaccggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacguccuuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggagaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaagaugcugaugacuggaacacuggcuguguuccuccuucucauaaugggacaauugacauggaaugaucugaucagacuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuccuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauucaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugccuuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaaaggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaacuuuugauacagaguaccaaaaaacaaaaaacaacgacugggacuacgucgucacaacagacaucuccgaaaugggagcuaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccuacgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauauugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggauccccaggaaaauuuuggaacaccacgauagcgguuuccauggcaaacauuuucagaggaaguuaucuagcaggagcaggucuggccuucucauugaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaauaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuguaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccugggcaagucauaugcacagauguggcagcugauguacuuccacaggagagaccugagauuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccacauauccaauuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5403 - RNA, 9879 nt, Artificial Sequence
  derived and/or modified CDS sequence (wt) from DENV-1__FJ639695__SS-prME
ucugugaccaugcuccucaugcugaugccuacagccuuggcguuccauuugacuacacgagggggagagccgcacaugauagucagcaagcaggaaagaggaaaaucacucuuguucaagaccucagcaggugucaacaugugcacccuuauagcgauggauuugggagaguuaugugaggacacaaugacuuacaaaugcccucgaaucacugaagcugaaccagaugacguugacuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggugcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagauaaaccaacauuagacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcuuuucggaaaaggaagccuaaugacgugugcuaaguucaagugugugacaaaacuggaaggaaagauaguucaauaugaaaacuugaaauauucaguaauagucaccguucacaccggagaccagcaucaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggauuagggguucugcugacauggcuaggauuaaacucaaggagcacgucccuuucgaugacgugcauugcaguuggccuaguaacacuauacuuaggagucaugguucaggcggauucaggauguguaaucaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuccuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucagggaaaacaagaagauaccuuccagccauaguccgugaggccauaaaaaggaagcugcguacacuaauucuggcucccacaagaguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggagccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuucuuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguggacuuacauccagcuucagccuggacccucuaugcaguggccacaacaauuaucacucccaugaugaggcacacaaucgaaaacacaacggcaaacauuucccugacagccauugcaaaucaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccccugaccacgcuuugggagggaucuccaggaaaauuuuggaacaccacgauagcgguuuccauggcaaacauuuucagaggaaguuaucuagcaggggcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgucuggcuggaaaaauauggcgucgaaaggcugaaaagaauggcaaucagcggagaugacugcguggugaaaccaauugaugauagguuugcaacagccuuaacagcucugaaugacaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5404 - RNA, 9879 nt, Artificial Sequence
  derived and/or modified CDS sequence (wt) from DENV-1__FJ639696__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaaaugcccucgaaucucugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggcaaugcgaugugugggaauaggcagcagggacuucguagaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguagaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacgucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauauuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauuccuuuuucgacccaagaugaaaaaggaguaacucagaauggaagacugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagauaccgcaugggacuuugguuccauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggcuuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacauuuuacuugaaaaugacaugaaauucacagugguuguaggagauguugcuggaauuuuggcucaagggaaaaaaaugauuaggccacaacccauggaauacaaguacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacgaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaagcuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaaugacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauucuaaaauuauugacugacuuucaaucacaucaguugugggccacuuugcuguccuugacauuuaucaaaacaacguuuuccuugcacuaugcauggaagacaauggccaugguacugucaauuguaucucucuuucccuuaugccuguccacgaccucccaaaaaacaacauggcuuccggugcuauugggaucucuuggaugcaaaccacuaaccauguuucucauagcagaaaacaaaaucuggggaaggaaaaguuggccccucaaugaaggaaucauggcuguuggaauagucagcauccuacuaaguucacuccucaaaaaugaugugccgcuagcugggccacugauagccggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagagaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggaacaucuggaucucccaucgugaacagagaaggaaaaauaguaggucuuuacggaaauggaguagugacaacaaguggaaccuacguuagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaaguugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcucaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgugaguuuaaagaguuugcagcaggaagaagaagcgucucaggugaucuaauacuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuggcuuugauagcuguguuaacugguggagugacgcuguucuuccuaucaggaaggggccuagggaaaacaucuaucggccuacucugcgugauggccucaagcguacugcuauggauggccaguguggagccccauuggauagcggccuccaucauacuggaauucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaauagaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaaccgcuaaacugaggugguuuguggagaggaaucuugugaaaccagaagggaaagucauagaccucgguuguggaagagguggcuggucauacuauugcgccgggcugaagaaggucacagaagugaagggauauacaaaaggaggaccuggacaugaggagccaauuccaauggcgaccuauggauggaaccuaguaaaacugcacuccgggaaagacguauucuuuguaccacccgagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaagcauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguagcaguggaaccagagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcgaaagaagcaguggaagaugagcgguucugggaccuugugcacagagagagggagcuucacaaacagggaaaaugcgcuacguguguuuacaacaugauggggaagagagagaaaaaacuaggagaguucggaaaggcaaaaggaagucgugcaauaugguacaugugguuaggagcacgcuuucuagaguucgaagcucuugguuucaugaacgaggaucacugguucagcagagagaauucacucagcggaguggaaggagaaggacuccacaaacuuggauauauacucagagacauaucaaagauuucagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauaucuagacgugaccagagaggaaguggccaggucggaacuuauggcuuaaauacuuucaccaacauggaagcccagcugauaagacagauggagucugaaggaaucuucucacccagcgaauuagagaccccaaauuuagccgagagagcucucgacuggcuggaaaaacauggcguugaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucuauccaugcccaucaccaauggaugacaacagaagacaugcugucaguguggaauaggguuuggauagaggaaaacccauggauggaggacaaaacccauauauccaguugggaagauguuccauauuuaggaaaaagggaagaucaaugguguggaucccugauaggcuuaacagcaagggccaccugggccacuaacauacaaguggccauaaaccaagugagaaggcuaauugggaaugagaauuaucuagauuacaugacaucaaugaagagauucaagaacgagagugaucuugaaggggcacucugguga

SEQ ID NO: 5405 - RNA, 9879 nt, Artificial Sequence
  derived and/or modified CDS sequence (wt) from DENV-1__HM181937__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcuggaaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcagguaauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauaaagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauagaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5406 - RNA, 9879 nt, Artificial Sequence
  derived and/or modified CDS sequence (wt) from DENV-1__HM181939__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaaaugcccucgaaucucugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggcaaugcgaugugugggaauaggcagcagggacuucguagaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaauaccaccacugacucaagauguccaacacaaggagaagccacacugguagaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacgucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauuccuuuuucgacccaagaugaaaaaggaguaacucagaauggaagacugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagauaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggcuuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacauuuuacuugaaaaugacaugaaauucacagugguuguaggagauguugcuggaauuuuggcucaagggaaaaaaaugauuaggccacaacccauggaauacaaguacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacgaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaagcuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaaugacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauucuaaaauuauugacugacuuucaaucacaucaguugugggccaccuugcuguccuugacauuuaucaaaacaacguuuuccuugcacuaugcauggaagacaauggccaugguacugucaauuguaucucucuuucccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaagaaugaugugccgcuagcugggccacugauagccggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccucaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagagaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggaacaucuggaucucccaucgugaacagagaaggaaagauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcucaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuggcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaauucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagauuuagggauuggccauguggcuguugaaaaucaccaccaugccgcaaugcuggacguagacuuacauccagcuucagccuggacccucuaugcaguggccacaacaauuaucacucccaugaugaggcacacaauagaaaacacaacggcaaacauuucccugacagccauugcaaaccaggcggcuauauuaaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggaccacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaaccgcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuuuguaccacccgagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaagcauggaggaaugcuagugcgaaauccacuuucaagaaauucuacucaugaaauguauuggguuucauguggaacaggaaacauugugucagcaauaaacaugacauccagaauguugcuaaaucgauucacaauggcucacaggaaaccaacauaugaaagagacguggaccuaggcgccggaacaagacauguagcaguggaaccagagguagccaaccuagauaucauuggccagaggauagagaacauaaaacaugaacauaagucaacauggcauuaugaugaggacaauccauacaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugcgccacguguguuuacaacaugauggggaagagagagaaaaaacuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuucagggggaaacauguaugcagaugacacagccggaugggauacaaggauaacagaggaugaccuucagaacgaggccaaaauuacugacaucauggaacccgaacaugcccuacuggcuaauucaaucuucaagcuaacauaccaaaauaaggugguaaggguacagagaccagcaaaaaauggaaccgugauggaugucauaucuagacgugaccagagaggaaguggccaggucggaacuuauggcuuaaauacuuucaccaacauggaagcccagcugauaagacagauggagucugaaggaaucuuuucacccagcgaauuagagaccccaaauuuagccgagagaguucucgacuggcuggaaaaacauggcguugaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucuauccaugcccaucaccaauggaugacaacagaagacaugcugucaguguggaauaggguuuggauagaggaaaacccauggauggaggacaaaacccauauauccaguugggaagauguuccauauuuaggaaaaagggaagaucaaugguguggaucccugauaggcuuaacagcaagggccaccugggccacuaacauacaaguggccauaaaccaagugagaaggcuaauugggaaugagaauuaucuagauuacaugacaucaaugaagagauucaagaacgagagugauccugaaggggcacucugguga

SEQ ID NO: 5407 - RNA, 9879 nt, Artificial Sequence
  derived and/or modified CDS sequence (wt) from DENV-1__HM181942__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaaaugcccucgaaucucugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggcaaugcgaugugugggaauaggcagcagggacuucguagaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaauaccaccacugacucaagauguccaacacaaggagaagccacacugguagaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacgucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauuccuuuuucgacccaagaugaaaaaggaguaacucagaauggaagacugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagauaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggcuuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacauuuuacuugaaaaugacaugaaauucacagugguuguaggagauguugcuggaauuuuggcucaagggaaaaaaaugauuaggccacaacccauggaauacaaguacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacgaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaagcuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaaugacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauucuaaaauuauugacugacuuucaaucacaucaguugugggccaccuugcuguccuugacauuuaucaaaacaacguuuuccuugcacuaugcauggaagacaauggccaugguacugucaauuguaucucucuuucccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacugauagccggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccucaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagagaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggaacaucuggaucucccaucgugaacagagaaggaaagauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcucaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuggcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaauucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagauuuagggauuggccauguggcuguugaaaaucaccaccaugccgcaaugcuggacguagacuuacauccagcuucagccuggacccucuaugcaguggccacaacaauuaucacucccaugaugaggcacacaauagaaaacacaacggcaaacauuucccugacagccauugcaaaccaggcggcuauauuaaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuagauccugugguuuaugaugcaaaauuugagaaacaacuaggccaaauaauguuguugauacuaugcacaucacaaauccucuugaugcggaccacaugggccuugugcgaauccaucacacuggccacuggaccccugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaaccgcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuuuguaccacccgagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaagcauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguagcaguggaaccagagguagccaaccuagauaucauuggccagaggauagagaacauaaaacaugaacauaagucaacauggcauuaugaugaggacaauccauacaaaacaugggccuaccauggaucauaugaggucaagccaucaggaucagccucauccauggucaauggcguggugaaacugcucaccaaaccaugggaugucauccccauggucacacaaauagccaugacugacaccacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugcgccacguguguuuacaacaugauggggaagagagagaaaaaacuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuucagggggaaacauguaugcagaugacacagccggaugggauacaaggauaacagaggaugaccuucagaacgaggccaaaauuacugacaucauggaacccgaacaugcccuacuggcuaauucaaucuucaagcuaacauaccaaaauaaggugguaaggguacagagaccagcaaaaaauggaaccgugauggaugucauaucuagacgugaccagagaggaaguggccaggucggaacuuauggcuuaaauacuuucaccaacauggaagcccagcugauaagacagauggagucugaaggaaucuuuucacccagcgaauuagagaccccaaauuuagccgagagaguucucgacuggcuggaaaaacauggcguugaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucuauccaugcccaucaccaauggaugacaacagaagacaugcugucaguguggaauaggguuuggauagaggaaaacccauggauggaggacaaaacccauauauccaguugggaagauguuccauauuuaggaaaaagggaagaucaaugguguggaucccugauaggcuuaacagcaagggccaccugggccacuaacauacaaguggccauaaaccaagugagaaggcuaauugggaaugagaauuaucuagauuacaugacaucaaugaagagauucaagaacgagagugauccugaaggggcacucugguga

SEQ ID NO: 5408 - RNA, 9879 nt, Artificial Sequence
  derived and/or modified CDS sequence (wt) from DENV-1__HM488255__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaagcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaauuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaagcggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauucaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaacuauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccauugugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcaucaaaucaggaaaugacauagccaacugcuuaagaaagaaugggaaacgggugauucaauugagcaggaaaaccuuugauacagaguaccaaaaaacaaaaaacaaugacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaagagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaaaauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugcccuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagagccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5409 - RNA, 9879 nt, Artificial Sequence
  derived and/or modified CDS sequence (wt) from DENV-1__HM181944__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucucugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggcaaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaauaccaccacugacucaagauguccaacacaaggagaagccacacugguagaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacgucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauuccuuuuucgacccaagaugaaaaaggaguaacucagaauggaagacugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagauaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggcuuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacauuuuacuugaaaaugacaugaaauucacagugguuguaggagauguugcuggaauuuuggcucaagggaaaaaaaugauuaggccacaacccauggaauacaaguacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacgaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaagcuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaaugacguaccuagcucugauggccacuuuuaaaaugagaccaauguuugcuguaggacuauuauuccgcagacuaacaucuagagaaguucuucuucuaacaauuggauugagucuaguggcaucuguggaguuaccaaauuccuuggaggagcugggggauggacuugcaaugggcauuaugauucuaaaauuauugacugacuuucaaucacaucaguugugggccaccuugcuguccuugacauuuaucaaaacaacguuuuccuugcacuaugcauggaagacaauggccaugguacugucaauuguaucucucuuucccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaagaaugaugugccgcuagcugggccacugauagccggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccucaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagagaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggaacaucuggaucucccaucgugaacagagaaggaaagauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcucaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuggcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaauucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagauuuagggauuggccauguggcuguugaaaaucaccaccaugccgcaaugcuggacguagacuuacauccagcuucagccuggacccucuaugcaguggccacaacaauuaucacucccaugaugaggcacacaauagaaaacacaacggcaaacauuucccugacagccauugcaaaccaggcggcuauauuaaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggaccacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaaccgcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuuuguaccacccgagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaagcauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguagcaguggaaccagagguagccaaccuagauaucauuggccagaggauagagaacauaaaacaugaacauaagucaacauggcauuaugaugaggacaauccauacaaaacaugggccuaccauggaucauaugaggucaagccaucaggaucagccucauccauggucaauggcguggugaaacugcucaccaaaccaugggaugucauccccauggucacacaaauagccaugacugacaccacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugcgccacguguguuuacaacaugauggggaagagagagaaaaaacuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuucagggggaaacauguaugcagaugacacagccggaugggauacaaggauaacagaggaugaccuucagaacgaggccaaaauuacugacaucauggaacccgaacaugcccuacuggcuaauucaaucuucaagcuaacauaccaaaauaaggugguaaggguacagagaccagcaaaaaauggaaccgugauggaugucauaucuagacgugaccagagaggaaguggccaggucggaacuuauggcuuaaauacuuucaccaacauggaagcccagcugauaagacagauggagucugaaggaaucuuuucacccagcgaauuagagaccccaaauuuagccgagagaguucucgacuggcuggaaaaacauggcguugaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucuauccaugcccaucaccaauggaugacaacagaagacaugcugucaguguggaauaggguuuggauagaggaaaacccauggauggaggacaaaacccauauauccaguugggaagauguuccauauuuaggaaaaagggaagaucaaugguguggaucccugauaggcuuaacagcaagggccaccugggccacuaacauacaaguggccauaaaccaagugagaaggcuaauugggaaugagaauuaucuagauuacaugacaucaaugaagagauucaagaacgagagugauccugaaggggcacucugguga

SEQ ID NO: 5410 - RNA, 9879 nt, Artificial Sequence
  derived and/or modified CDS sequence (wt) from DENV-1__HM181946__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaagcugaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccucuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagcuuaauaacgugugcuaaguucaagugugugacaaaacuggaaggaaagauaguucaauaugaaaacuugaaauauucaguaauaguuaccguucacaccggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauuuaagcuagagaaagaaguggcugagacccagcauggaaccguucuagugcagauuagauaugaaggaacagaugcaccaugcaagaucccuuuuucgacccaagaugaaagaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacguccuuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggagaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaagaugcugaugacuggaacacuggcuguguuccuccuucucauaaugggacaauugacauggaaugaucugaucagacuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuccuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauucaucaaaacaacguuuuccuugcacuaugcauggaagacaauggcuaugguacugucaauuguaucucucuuucccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggagaaguuggagccauugccuuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaaaggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcaucaaaucaggaaaugacauagccaacugcuuaagaaagaaugggaaacgggugauucaauugagcaggaaaaccuuugauacagaguaccaaaaaacaaaaaacaaugacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccuacgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggaccccgugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuguaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucauaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggacgucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5411 - RNA, 9879 nt, Artificial Sequence
  derived and/or modified CDS sequence (wt) from DENV-1__HM181948__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaguugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacauuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuaugucauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccuuaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauucccgagagaucauggaacucaggcuaugaguggaucacugacuucccagguaaaacaguuugguuuguuccaagcaucaaaucaggaaaugacauagccaacugcuuaagaaagaaugggaaacgggugauucaauugagcaggaaaaccuuugauacagaguaccaaaaaacaaaaaacaaugacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaaaauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugcccuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5412 - RNA, 9879 nt, Artificial Sequence
  derived and/or modified CDS sequence (wt) from DENV-1__HM181949__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacaggacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaagcggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauaugguugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcauguuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccauugugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcaucaaaucaggaaaugacauagccaacugcuuaagaaagaaugggaaacgggugauucaauugagcaggaaaaccuuugauacagaguaccaaaaaacaaaaaacaaugacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaagagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaaaauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugcccuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagagccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5413 - RNA, 9879 nt, Artificial Sequence
  derived and/or modified CDS sequence (wt) from DENV-1__HM181950__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcagguguuaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccacuauggcaaaagacaaaccaacauuggacauugaacucuugaagacggaagucacaaacccugccauccugcgcaaacugugcaucgaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaucaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggagcugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccgcuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcggcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguucguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggcuuugugcgaauccaucacacuggccaccggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggauaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugagaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguagaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauagcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggauuccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5414 - RNA, 9879 nt, Artificial Sequence
  derived and/or modified CDS sequence (wt) from DENV-1__HM181952__SS-prME
ucugugaccaugcuccuuaugcugaugccuacagcccuggcguuccauuugacuacacgagggggagagccgcacaugauagucagcaagcaggaaagaggaaagucacuuuuguuuaagaccucagcaggugucaauaugugcacccuuauagcgauggauuugggagagcuaugugaggacacaaugacuuacaaaugcccucgaaucacugaggcggaaccggaugacguugauuguuggugcaaugccacagacacaugggugaccuauggaacauguucccaaacuggcgagcaccgacgagaaaaacguuccgucgcacuggccccacacgugggacuugguuuggaaacaagaacugaaacguggauguccucugaaggcgcuuggaaacagauacaaaggguggagacuugggcccugagacacccaggauucacggugauagcccuuuuucuagcacaugccauaggaacaucuaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuacuaacgugugcuaaguucaagugugugacaaaacuggaaggaaagauaguucaauaugaaaacuugaaauauucaguaauagucaccguccacacuggagaccagcaucaggugggaaaugaaagcacagaacaugggacaaccgcaacuauaacaccucaagcucccacgacggaaauacagcugaccgacuacggagcucuuacauuggauuguucaccuagaacaggacuagacuuuaaugaaaugguguugcugacaaugaaagaaaaaucauggcuaguccacaaacaaugguuucuagacuuaccacugccuuggacuucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacucagcauggaaccguucuagugcagauuaaauaugaaggaacagaugcaccaugcaagauuccuuuuucgacccaagaugaaaaaggaguaacccagaaugggagauugauaacagccaaccccauagucacugacaaggaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccucucgaugacgugcauugcaguuggccuaguaacacuauaccuaggagucaugguucaggcggacucaggaugcguaauuaauuggaaagguagagaacucaaauguggaagugguauuuuugucaccaaugaaguucacacuuggacagagcaauacaaauuucaagcugacuccccaaagagacuaucagcagccauugggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuugguucaaggaaaaaaaaugauuaggccacaacccauggaauacaaauacucguggaaaagcuggggaaaagcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggcuacuggauagaaagugaaaagaacgagaccuggaagcuggcaaaagccucuuucauagaaguuaaaacauguauuuggccaaaaucccacacucuauggagcaauggaguucuggaaagugaaaugauaauuccaaagauccauggaggaccaauaucucagcauaacuacagaccaggauauuucacacaaacggcagggccguggcaccuaggcaaguuggaacuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacauuggcuguguucuuccuucuuauaaugggacaguugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaaugggcaucaugauuuuaaaauuauugacugacuuucaaucauaucaguugugggcuaccuugcuguccuugacauuuaucaaaacaacguuuucccugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuaauagcagaaaacaaaauuuggggaaggaaaaguuggccccucaaugaagggaucauggcuguuggaauagucagcauccuauuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucaggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuuguguggcacuuuuggcagaaaaagaaacagagaucuggaguguugugggacacaccuagcccuccagaaguggaaagagcaguucuugaugaugguaucuauagaauuaugcagagaggacuguugggcaggucccaaguaggggugggaguuuuucaagaaaacguguuccacacaauguggcaugucaccaggggagcuguacucauguaucaagggaagagacuggaaccgagcugggccagugucaaaaaagaccugaucucauauggaggaggcuggaggcuucaaggauccuggaacacgggagaagaagugcaggugauugcuguugaaccagggaaaaaccccaaaaauguacaaacagcgccgggcaccuuuaagaccccugaaggugaaguuggagccauugcccuagauuucaaacccggcacaucuggaucucccaucgugaacagagaagggaaaauaguaggucuuuauggaaauggaguagugacaacaaguggaaccuacgucagugccauagcucaagccaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaagcgcucaagggaaugccaauaagguaccaaacaacagcagugaagagugaacacacaggaaaagagauaguugaccucaugugucacgccacuuucaccaugcgccuccugucucccgugagaguucccaauuacaauaugauuaucauggaugaagcacauuucaccgauccauccagcauagcggccagaggguacaucucaacccgagugggcaugggugaagcagcugcaaucuucaugacagccacucccccaggaucaauggaggccuuuccacagagcaacgcaguuauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaaaaccuuugauacagaguaucaaaaaacaaaaaauaacgacugggacuacgucgucacaacagacaucuccgaaaugggagcaaauuuccgggccgacagggugauagacccaagacggugucugaaaccgguaauauuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccuuuuugagccggagagagaaaagagugcagcaauagacggggaauauagacugcggggugaagcaaggaaaacauuuguggagcucaugagaagaggagaccuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaauuacgaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaacuuggucauguugcacaacuccgaacaaggaggaagagccuauagacaugcaauggaagaacugccagacaccauagaaacauugaugcuccuugcuuugauagcuguguuaacugguggagugacgcuguucuuccuaucaggaaagggccuagggaaaacaucuaucggccuacucugcgugauggcuucaagcguacuacuauggauggccaguguggagccccauuggauagcggccuccaucauacuggaguucuuccuaaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaggugaauccacugacgcugacagcggcgguguugaugcuaguggcucauuacgccauaguuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaauguuguugauacuaugcacaucacagauccucuugaugcggacuacaugggcccugugcgaauccaucacacuggccacuggaccucugaccacgcuuugggagggaucuccaggaaaauuuuggaacaccacgauagcgguuuccauggcaaacauuuuuagaggaaguuaucuagcaggagcaggucuggccuucucguuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaaguuauagaccuugguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuauaccaccugagaaaugugauacccuuuugugugauauuggugaguccucuccaaacccaacuauagaggaaggaagaacgcuacgcguucuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguuacuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagaaaaaaaacuaggagaguucggaaaggcaaaaggaagucgugcaauaugguacaugugguugggagcacgcuuucuagaguuugaagcucuugguuucaugaacgaagaucacugguucagcagagagaauucacucagcggaguggaaggagaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaaccuauggcuuaaacacuuucaccaacauggaagcccagcugauaagacaaauggagucugagggaaucuuuuuacccaacgaauuagagaccccaaauuuagccgagagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuauuuguucagccguuccaguugacugggucccaaccagccgcaccaccuggucgauccaugcccaucaccaauggaugacaacagaagacaugcugucaguguggaauaggguuuggauagaggaaaacccauggauggaggacaaaacccguauauccaguugggaagauguuccauaucuaggaaaaagggaagaucaaugguguggaucucugauaggcuuaacagcaagggccaccugggccaccaacauacaaguggccauaaaccaagugagaagacuaauugggaaugagaauuauucagauuacaugacaucaaugaagagauucaagaacgagagugaacccgaaggggcacucugguga

SEQ ID NO: 5415 - RNA, 9879 nt, Artificial Sequence
  derived and/or modified CDS sequence (wt) from DENV-1__HM181953__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuuggcuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauugcucaccuagaacaggacuagacuuuaaugaaaugguguugcugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuugguucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccagacaacagcagugaagagugaacacacaggaaaagagauaguugaccucaugugucacgccacuuucaccaugcgccuccugucucccgugagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaauaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagauggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaagggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacauuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaaguuagaauuuaacaccuauaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaggggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacgucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaguauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccguaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5416 - RNA, 9879 nt, Artificial Sequence
  derived and/or modified CDS sequence (wt) from DENV-1__KF921933__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaaaauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauugcucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaagcggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauaugguugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagacuaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaccuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcauguuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccauugugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaagccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcaucaaaucaggaaaugacauagccaacugcuuaagaaagaaugggaaacgggugauucaauugagcaggaaaaccuuugauacagaguaccaaaaaacaaaaaacaaugacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugggcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaaaauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagacgauugcguggugaaaccaauugaugauagguuugcaacagccuuaacagcucugaacgauaugggaaaaguaagaaaagauauaccacaaugggaaccuucaaaaggauggaaugauuggcaacaagugcccuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagagccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5417 - RNA, 9879 nt, Artificial Sequence
  derived and/or modified CDS sequence (wt) from DENV-1__HM181954__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcagguguuaacaugugcacccuuauagcgauggauuugggagaguuaugugaggacacaaugaccuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccacuauggcaaaagacaaaccaacauuggacauugaacucuugaagacggaagucacaaacccugccauccugcgcaaacugugcaucgaagccaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaucaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccccgggagcuucaacaucacaagagacuuggaacagacaagauuugcuggugacauuuaagacagcccaugcaaagaagcaggaaguagucguacuaggaucacaagaaggagcaaugcacaccgcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggagcugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagcgugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccgcuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggccuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggcuuugugcgaauccaucacacuggccaccggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugagaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguagaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggugucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggauuccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5418 - RNA, 9879 nt, Artificial Sequence
  derived and/or modified CDS sequence (wt) from DENV-1__HM181955__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagccgaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaagcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaauaccaccaccgacucaagauguccaacacaaggagaagccacacugguggaagaacaagacgcgaauuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaaacuggcaagagccucuuucauagaaguuaaaacauguaucuggccaaaaucccacacucuauggagcaauggaguucuagaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagauggcugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacugguuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucugguggcaucuguggaguuaccaaauuccuuggaggagcugggggauggacuugcaaugggcauuaugauuuuaaaauuauugacugacuuucaaucacaucagcugugggcuaccuugcugucuuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggacuuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuagaaauagggaaacuuccacaacacuugacgcaaagggcccagaaugccuuggacaaccugguuauguugcacaauuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcgaacauuucccugacagccauugcaaaccaggcagcuauauugaugggacuugacaaaggauggccaauaucgaagauggacauaggaguuccacuucuugccuuggggugcuauucccaggugaauccacugacgcugacagcggcgguauugaugcuaguggcucauuacgccauaauuggaccuggacugcaagcaaaagcaacuagagaagcucaaaaaaggacagcggccggaauaaugaaaaauccaaccguugacgggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccuugguuguggaagagguggcuggucauacuauugcgcugggcugaagaaagucacagaagugaagggauacacaaaagggggaccuggacaugaggagccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagggagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagauuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5419 - RNA, 9879 nt, Artificial Sequence
  derived and/or modified CDS sequence (wt) from DENV-1__HM181959__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaagccgaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaagcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaauaccaccaccgacucaagauguccaacacaaggagaagccacacugguggaagaacaagacgcgaauuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucauaccggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaagucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaaacuggcaagagccucuuucauagaaguuaaaacauguaucuggccaaaaucccacacucuauggagcaauggaguucuagaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagauggcugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacugguuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucugguggcaucuguggaguuaccaaauuccuuggaggagcugggggauggacuugcaaugggcauuaugauuuuaaaauuauugacugacuuucaaucacaucagcugugggcuaccuugcugucuuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggacuuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuagaaauagggaaacuuccacaacacuugacgcaaagggcccagaaugccuuggacaaccugguuauguugcacaauuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcgaacauuucccugacagccauugcaaaccaggcagcuauauugaugggacuugacaaaggauggccaauaucgaagauggacauaggaguuccacuucuugccuuggggugcuauucccaggugaauccacugacgcugacagcggcgguauugaugcuaguggcucauuacgccauaauuggaccuggacugcaagcaaaagcaacuagagaagcucaaaaaaggacagcggccggaauaaugaaaaauccaaccguugacgggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccuugguuguggaagagguggcuggucauacuauugcgcugggcugaagaaagucacagaagugaagggauacacaaaagggggaccuggacaugaggagccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagggagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagauuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5420 - RNA, 9879 nt, Artificial Sequence
  derived and/or modified CDS sequence (wt) from DENV-1__JF937651__SS-prME
ucugugaccaugcuccuuaugcugaugccuacagccuuggcguuccauuugacuacacgagggggagagccgcacaugauacucagcaagcaggaaagaggaaaaucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcguuaccacuauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaucaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacauuugaaaugcagacuaaagauggacaaacugacucuaaaagggaugucauaugugaugugcacaggcucauucaagcuagagaaagaaguggcugagacccagcauggaaccguccuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaauacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuugcgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucauaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccgcuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucuacuggcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggcuauaaaaaggaaguugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguauuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaagcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcuguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguguucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaucuagauaucauuggccagaggauagagaacauaaaacaugaacacaagucaacauggcauuaugaugaggacaauccauauaaaacaugggccuaucauggaucguaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucucucuagaaacaagaaaccaagaauuugcacaagagaggaguucacaggaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguagaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccaaaggggcacucugguga

SEQ ID NO: 5421 - RNA, 9879 nt, Artificial Sequence
  derived and/or modified CDS sequence (wt) from DENV-1__GU131956__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacggacacaugggugaccuaugggacguguucucaaaccggcgaacaccgacgagacaaacguuccguggcacuggccccacacgugggacuuggucuagaaacgagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaccauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccggucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccacuuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcaggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccaugguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagcccuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaaguuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggccacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaauuagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacaaacauacaaguggccauaaaccaagugagaaggcucaucgggaaugagaauuaucuagauuauaugacaucaaugaagagauucaagaaugagagugaucccgaaggggcacucugguga

SEQ ID NO: 5422 - RNA, 9879 nt, Artificial Sequence
  derived and/or modified CDS sequence (wt) from DENV-1__GU131958__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguucuguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugugugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaggcggacucgggauguguaaucaacuggaagggcagagaacucaaauguggaaguggcauuuuuguuaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcucaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucucagcacaacuacagaccaggguacuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccucaaaaaugaugugccguuggccggcccacugauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaagauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugccacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaagucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaagcuacacucuggaaaagauguauuuuuuaugccaccugagaaaugugacacccuucugugugauauuggugaauccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaccaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5423 - RNA, 9879 nt, Artificial Sequence
  derived and/or modified CDS sequence (wt) from DENV-1__GQ868499__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcggacaccgacgagagaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccgucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccucgaacagggcuggacuuuaaugagauggugcuauugacaaugaaagaaaaaucauggcuuguccacaaacaaugguuucuggacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagacugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguaacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguauuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagauguugaugacuggaacacuggcuguuuuccuccuucuuauaaugggacaacugacauggaaagaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccuuggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaagcuggccccucaaugaaggaauuauggcuauuggaauaguuagcauucuacuaaguucacuccucaaaaaugaugugccguuggcuggcccacuaauagcuggaggcaugcuaauagcauguuaugucauaucuggaagcucagccgauuuaucauuggagaaaguggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuucacacaauguggcacgucaccaggggagcuguccuuauguaccaagggaagaggcuggaaccaagcugggccaguguaaaaaaggauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacauuggcuacuggaccccugaccacccucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuaucccuauggucacacaaauagcuaugaccgacaccacacccuuuggacaacagagaguguuuaaagagaaaguugacacgcgcacaccaagagcaaaacgaggcacuacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuauaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5424 - RNA, 9879 nt, Artificial Sequence
  derived and/or modified CDS sequence (wt) from DENV-1__GQ868500__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacggacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccggucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauccgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuuaauggcuacuuucaaaaugagaccaauguucgcuguugggcuauuauuucgcagacuaacaucuagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccucucaaugaaggaauuauggcuauuggaauaguuagcauccuacuaaguucacuccucaaaaaugaugugccguuggccggcccacuaauagcaggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccaugguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucaguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagcccuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaucagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucgugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaaguuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucaaacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguuggugaaaaccaauggaacucagcaaaagaagcaguggaagacgaaaggguuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagcugguugggacacaagaauaacagaggaugaucuucagaaugaggcuaaaaucacugaaaucauggagccugaacaugcucuauuggccacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacugauaagacaaauggagucugaaggaaucuuuuuacccagcgaauuggaaacccccaaucuagcugagagaguucuugacugguuggaaaaacauggcgccgaaaggcugaaaagaauggcaauuagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5425 - RNA, 9879 nt, Artificial Sequence
  derived and/or modified CDS sequence (wt) from DENV-1__GU131961__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguucuguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugugugggaauaggcaacagagacuucguugaaggacugucaggagcaacguggguggacgugguauuggagcauggaagcugcgucacuaccauggcaaaaaauaaaccaaccuuggacauugaacuccugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaggcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcucaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucucagcacaacuacagaccaggguacuucacacaaacagcagggccauggcaccuaggcaaguuagaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguuggacuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccuuaaaaaugaugugccguuggccggcccacugauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaagauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacucccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaacuaucuagacuauaugacaucaaugaagagauucaagaaugagagugaucccgaagggguacucugguga

SEQ ID NO: 5426 - RNA, 9870 nt, Artificial Sequence
  derived and/or modified CDS sequence (wt) from DENV-1__GU131962__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugcuaaguucaagugugugacaaaacuagaaggaaagauaguucaauaugaaaaccuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccauugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaacaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuacccccccuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgcuacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgcgucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacacgccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaacuaaacaugcagugucgagaggaacagccaaacugaggugguuuguggagaggaaccucgugaaaccagaagggaaagucauagaccucgguuguggaagagguggcuggucauauuauugugcugggcugaagaaagucacggaauacgcaucagcaggacuugcaauuauugucccucucccauuggacaccuauggacggaaccgauuaaagauacacucuggaaaagauguauuuuuuaugccaccugagaaaggugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaaguguaguagaagcucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguucaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacauggggaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaucaagugagaaggcucaucgggaaugagaauuaucuagauuacaugacaucaaugaagagauucaagaaugagagugaucccgaaggggcacucugguga

SEQ ID NO: 5427 - RNA, 9879 nt, Artificial Sequence
  derived and/or modified CDS sequence (wt) from DENV-1__GU131963__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacgagaaccgaaacauggauguccucugaaggcgccuggaaacaaauacaaagaguggagacuugggcuuugagacacccaggauucacggugauagccuuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaaccuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgcuacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaacuaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaagcucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguucaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacauggggaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugccugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucaaguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuacaugacaucaaugaagagauucaagaaugagagugaucccgaaggggcacucugguga

SEQ ID NO: 5428 - RNA, 9879 nt, Artificial Sequence
  derived and/or modified CDS sequence (wt) from DENV-1__KF955442__SS-prME
uccgugaccaugcuucucaugcugcugcccacagcccuggcguuccauuugaccacacgagggggagagccacacaugauaguuagcaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguucuguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugcuauaggaacauccaucacucagaaagggaucauuuucauuuugcugaugcuggugacaccaucaauggccaugcgaugugugggaauaggcaacagagacuucguugaaggacugucaggagcaacguggguggacgugguauuggagcauggaagcugcgucacuaccauggcaaaaaauaaaccaaccuuggacauugaacuccugaagacggaggucacgaacccugcuaucuugcgcaaacuguguauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaagugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcucaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucucagcacaacuacagaccaggguacuucacacaaacagcagggccauggcaccuaggcaaguuggaauuggauuuugacuugugugaugguaccacaguuguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaaucauggcuauuggaauaguuagcauucuacuaaguucacuccucaaaaaugaugugccguuggccggcccacugauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaagauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaauugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucagggaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggcuuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugauccugaaggggcacucugguga

SEQ ID NO: 5429 - RNA, 9879 nt, Artificial Sequence
  derived and/or modified CDS sequence (wt) from DENV-1__GU131965__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuuggguuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaacugcauaugggguucuguuuagcgguguuucuuggacuaugaaaauaggaauagggauucugcugacaugguugggauuaaauucaaggaacacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugaucaggccacaacccauggaacacaaauacucauggaaaagcuggggaaaagcuaaaaucauaggagcagacauacaaaauaccaccuucaucaucgacggcccagacaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaggguaccacagucguuguggaugaacauuguggaaaucgagguccuucucucagaaccacaacagccacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcaggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguauccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagacuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacacuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacagggugauagacccaaggcggugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuguuggaaaccacaaagaaagaccuggggauuggccauguagccgccgaaaaccaccaacaugcuacaaugcuggacguggaccuacguccagcuucagccuggacucucuaugcaguagccacaacaguuaucacucccaugaugagacacacaauugaaaacacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaauaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcuaagaggaaaccaauucuguauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugacgaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgagguacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacuucacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagcuuuaacagcccugaaugacaugggaaaaguaagaaaagacauaccgcagugggaaccuucaaaaggauggaaugauuggcagcaagugccuuucuguucgcaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5430 - RNA, 9879 nt, Artificial Sequence
  derived and/or modified CDS sequence (wt) from DENV-1__GU131966__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguucuguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucucagcacaacuauagaccaggguacuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagagguucuucuucucacgauuggauuaagcuugguggcauccguggagcuaccaaauucuuuagaggagcuaggggauggacuugcaauggguaucaugauguuaaaauuauugacugaauuucagccacaccaguuguggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggauuguugggcaggucccaaguaggagugggaguuuuccaagacggcguguuccacacaauguggcacgucaccaggggggcuguccuuauguaccaagggaagaggcuggaaccaagcugggccagugucaaaaaggauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccagcugagcaagucagaauucaacaccuacagaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggugccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5431 - RNA, 9879 nt, Artificial Sequence
  derived and/or modified CDS sequence (wt) from DENV-1__GQ868501__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguucuguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugugugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguuuagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccauauucuacuugaaaaugacaugaaauucacagugguuguaggagaugcuaauggaauuuuggcucaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaucggcuaaugucagcugccaucaaagacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucucagcacaacuacagaccaggguacuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacauuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugacuggaacacuggcugucuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaaccaaaucuggggaaggaaaaguuggccccucaaugaaggaauuauggcaauuggaauaguuagcauucuacuaaguucacuccucaaaaaugaugugccguuggccggcccacugauagcuggaggcaugcuaauagcauguuaugucauauccggaagcucagccgauuuaucauuggagaaaacggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaagauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuguccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauaggcaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugaugguguugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuauuuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccauccucauggcgacauauggauggaaccuaguagagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaaucauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagagagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagagugucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaagacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5432 - RNA, 9879 nt, Artificial Sequence
  derived and/or modified CDS sequence (wt) from DENV-1__HQ166035__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugcuaaguucaagugugugacaaaacuagaaggaaagauaguucaauaugaaaaccuaaaauauucagugauagucacuguccacacuggggaccagcaccaggugggaaacgagacuacagaacauggaacaauugcgaccauaacaccucaagcuccuacgucggaaauacggcugaccgacuacggagcccucacauuggacugcucaccuagaacagggcuggacuuuaaugagauggugcuauugacaaugaaagaaaaaucauggcuuguccacaaacaaugguuucuagacuuaccauugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaacaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuacccccccuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuaugcuggcagucucaggaguguaccccaugucaauaccagcaacuccuuuugugugguacuuuuggcagaaaaagaaacagagaaucagaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagaggaaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgcuacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgcgucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacacgccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaacuaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaaguguaguagaagcucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguucaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacauggggaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaucaagugagaaggcucaucgggaaugagaauuaucuagauuacaugacaucaaugaagagauucaagaaugagagugaucccgaaggggcacucugguga

SEQ ID NO: 5433 - RNA, 9879 nt, Artificial Sequence
  derived and/or modified CDS sequence (wt) from DENV-1__GQ868502__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacggacacaugggugaccuaugggacguguucucaaaccggcgaacaccgacgagacaaacguuccguggcacuggccccacacgugggacuuggucuagaaacgagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaccauuuucauuuugcugaugcuggcgacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgacucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagacaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccggucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccacuuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuagcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaaccauguuucucauaacagaaaacaaaaucuggggaaggaaaaguuggccccucaaugaaggaauuauggcuauuggaauaguuagcauccuacuaaguucacuccucaaaaaugaugugccguuggccggcccacuaauagcaggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccaugguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggaaauaguugaccucaugugccacgccacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagcccuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaaguuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuucggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaauuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggccacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaauuagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacaaacauacaaguggccauaaaccaagugagaaggcucaucgggaaugagaauuaucuagauuauaugacaucaaugaagagauucaagaaugagagugaucccgaaggggcacucugguga

SEQ ID NO: 5434 - RNA, 9879 nt, Artificial Sequence
  derived and/or modified CDS sequence (wt) from DENV-1__GQ868503__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguagacugcuggugcaaugccacagacacaugggugaccuaugggacguguucucaaaccggcgaacaccgacgagacaaacguucuguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugugugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaaaaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaauuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcucaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggagagagccuccuucauagaagucaagacaugcaccuggccgaaaucucacacucuauggagcaauggaguuuuggaaagugaaaugauaaucccaaagauauauggaggaccaauaucucagcacaacuacagaccaggguacuucacacaaacagcagggccauggcaccuaggcaaguuggaauuggauuuugacuugugugaagguaccacagucguuguggaugaacauuguggaaaucgagguccuucucucagaacuacaacaguuacaggaaagauaauccaugaaugguguugcagauccugcacguuacccccuuuacguuucagaggagaagacggauguugguauggcauggaaaucagaccaguaaaggagaaggaggagaauuuaguuaggucaauggucucugcagggucaggagaaguggacaguuuuucauuaggaauacuaugcgcaucaauaaugauugaagaagugaugagaucuagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccucaaaaaugaugugccguuggccggcccacugauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaggaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaggauuugaucucauauggaggggguuggagguuucaaggaucauggaacacgggagaagaagugcaggugauagcuguugaaccaggaaaaaaccccaaaaauguacagacaacgccggguaucuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagauauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccucaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuaggguguuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucguacacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5435 - RNA, 9879 nt, Artificial Sequence
  derived and/or modified CDS sequence (wt) from DENV-1__GQ868504__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacgugcucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugcuaaguucaagugugugacaaaacuagaaggaaagauaguucaauaugaaaaccuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccauugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaacaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuacccccccuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagggugaacacacaggaagggagauaguugaccucaugugccacgcuacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgcgucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguaccccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacacgccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaacuaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaaguguaguagaagcucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguucaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacauggggaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuaggaaaaagggaagaucaaugguguggaucccugauaggcuugacagcgagggccaccugggccacuaacauacaaguggccauaaaucaagugagaaggcucaucgggaaugagaauuaucuagauuacaugacaucaaugaagagauucaagaaugagagugaucccgaaggggcacucugguga

SEQ ID NO: 5436 - RNA, 9879 nt, Artificial Sequence
  derived and/or modified CDS sequence (wt) from DENV-1__GU131967__SS-prME
uccgugaccaugcuucucaugcugcugcccacagcccuggcguuccauuugaccacacgagggggagagccacacaugauagucaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugcuaaguucaagugugugacaaaacuagaaggaaagauaguucaauaugaaaaccuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccauugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaacaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaacgugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuacccccccuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgcuacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgcgucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacacgccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaacuaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacauggggaaccuaucccacuggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaaguguaguagaagcucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguucaaagagaaaguugacacgcgcacaccaagagcaaaacgaggcacaacacaaauuauggaggugacagccaagugguuaugggguuuccucuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagggacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacauggggaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaucaagugagaaggcucaucgggaaugagaauuaucuagauuacaugacaucaaugaagagauucaagaaugagagugaucccgaaggggcacucugguga

SEQ ID NO: 5437 - RNA, 9879 nt, Artificial Sequence
  derived and/or modified CDS sequence (wt) from DENV-1__GU131968__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguagacugcuggugcaaugccacagacacaugggugaccuaugggacguguucucaaaccggcgaacaccgacgagacaaacguucuguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugugugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaagucaaauacgaaggaacagacgcgccaugcaagauccccuuuucgacccaaaaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaauuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcucaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggagagagccuccuucauagaagucaagacaugcaccuggccgaaaucucacacucuauggagcaauggaguuuuggaaagugaaaugauaaucccaaagauauauggaggaccaauaucucagcacaacuacagaccaggguacuucacacaaacagcagggccauggcaccuaggcaaguuggaauuggauuuugacuugugugaagguaccacagucguuguggaugaacauuguggaaaucgagguccuucucucagaacuacaacaguuacaggaaagauaauccaugaaugguguugcagauccugcacguuacccccuuuacguuucagaggagaagacggauguugguauggcauggaaaucagaccaguaaaggagaaggaggagaauuuaguuaggucaauggucucugcagggucaggagaaguggacaguuuuucauuaggaauacuaugcgcaucaauaaugauugaagaagugaugagaucuagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccucaaaaaugaugugccguuggccggcccacugauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugaugggacuaugaaaauaaaagaugaagagagggaugacacacucacuauacuccuuaaagcaacuuugcuggcagucucaggaguguacccaaugucaauaccagcaacucuuuuugugugguacuuuuggcagaaaaggaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaggauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagauauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccucaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuaggguguuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagcuaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucguacacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5438 - RNA, 9879 nt, Artificial Sequence
  derived and/or modified CDS sequence (wt) from DENV-1__GQ868506__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagccuuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugcuaaguucaagugugugacaaaacuagaaggaaagauaguucaauaugaaaaccuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccauugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaacaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuacccccccuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccgggcaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgcuacuuuuaccaugcgucucuuauccccagggagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgcgucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacacgccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaacuaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaaguguaguagaagcucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguucaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacauggggaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaucaagugagaaggcucaucgggaaugagaauuaucuagauuacaugacaucaaugaagagauucaagaaugagagugaucccgaaggggcacucugguga

SEQ ID NO: 5439 - RNA, 9879 nt, Artificial Sequence
  derived and/or modified CDS sequence (wt) from DENV-1__GQ868507__SS-prME
uccgugaccaugcuucucaugcugcugcccacagcccuggcguuccauuugaccacgcgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacggacacaugggugaccuaugggacguguucucaaaccggcgaacaccgacgagacaaacguuccguggcacuggccccacacgugggacuugguuuagaaacgagaaccgaaacauggauguccucugaaggcgccuggaagcaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccggucaacauugagacagaaccacccuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagggccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacaauuggauuaagcuugguggcaucuguggagcuaccaaauucuuuggaggagcuaggggauggacuugcaauggguaucaugauguuaaaauuauugacugaauuucagccacaccaguuauggaucaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcaggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguauuaugggacacacccagcccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaaugccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccaugguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagcccuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaaguuacccucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggauaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaauaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggccacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaauuagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacaaacauacaaguggccauaaaccaagugagaaggcucaucgggaaugagaauuaucuagauuauaugacaucaaugaagagauucaagaaugagagugaucccgaaggggcacucugguga

SEQ ID NO: 5440 - RNA, 9879 nt, Artificial Sequence
  derived and/or modified CDS sequence (wt) from DENV-1__GQ868508__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacggacacaugggugaccuaugggacguguucucaaaccggcgaacaccgacgagacaaacguuccguggcacuggccccacacgugggacuugguuuagaaacgagaaccgaaacauggauguccucugaaggcgccuggaagcaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccggucaacauugagacagaaccacccuuuggugagagcuacaucgugguaggagcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagggccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacaauuggauuaagcuugguggcaucuguggagcuaccaaauucuuuggaggagcuaggggauggacuugcaauggguaucaugauguuaaaauuauugacugaauuucagccacaccaguuauggaucaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccucucaaugaaggaauuauggcuauuggaauaguuagcauccuacuaaguucacuccucaaaaaugaugugccguuggccggcccacuaauagcaggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguauuaugggacacacccagcccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaaugccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccaugguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagcccuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaaguuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaauaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggccacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaauuagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacaaacauacaaguggccauaaaccaagugagaaggcucaucgggaaugagaauuaucuagauuauaugacaucaaugaagagauucaagaaugagagugaucccgaaggggcacucugguga

SEQ ID NO: 5441 - RNA, 9879 nt, Artificial Sequence
  derived and/or modified CDS sequence (wt) from DENV-1__GQ868509__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguucuguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugugugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaagugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagaugucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucggugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagucacgcgucuugagaacaucauguggaagcaaauaucaaaugaauugaaccacauucuacuugaaaaugacaugaaauucacagugguuguaggagaugcuaauggaauuuuggcucaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaagacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucucagcacaacuacagaccaggguacuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguccuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccucaaaaaugaugugccguuggccggcccacugauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaggaugaagagagggaugacacacucacuauacuccuuaaagcaacuuugcuggcagucucaggaguguacccaaugucaauaccagcaacucuuuuuuuaugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaagauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuggaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5442 - RNA, 9879 nt, Artificial Sequence
  derived and/or modified CDS sequence (wt) from DENV-1__GQ868510__SS-prME
uccgugaccaugcuucucaugcugcugcccacagcccuggcguuccauuugaccacacgagggggagagccacacaugauaguuagcaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcggacaccgacgagagaaacguuccguggcacuggccccacacgugggacuaggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguggaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggauagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccucgaacagggcuggacuuuaaugagauggugcuauugacaaugaaagaaaaaucauggcuuguccacaaacaaugguuucuggacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacgggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacauuauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacgguccagauaccccagaaugccccgauauccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguauuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaagaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggauggacuugcaauggguaucaugauguuaaaauuauugacugaauuucagccacaccaauuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuaggaugcaaaccguuaacuauguuucuuauaacagaaaacaaaaucuggggaagaaaaagcuggccccucaaugaaggaauuauggcuauuggaauaguuagcauucuacuaaguucacuccucaaaaaugaugugccguuggccggcccacuaauagcuggaggcaugcuaauagcauguuaugucauaucuggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuucaagacggcguguuucacacaauguggcacgucaccaggggagcuguccuuauguaccaagggaagaggcuggaaccaagcugggccaguguaaagaaggauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugagcacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauauuaaaagaugguccagagcgugucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccugauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugcgugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacccucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagaaggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacgugucuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgacaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuauaacaugauggggaagagagagaaaaaacuaggagaguuuggaaaggcaaaaggaagucgugcaauaugguacauguggcugggagcacgcuuucuggaguucgaagcccuugguuucaugaaugaagaccacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuccagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguugggaaaacauggcgccgaaaggcugaaaagaauggcaaucagcggagaugauugcguggugaaaccaauugaugacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5443 - RNA, 9879 nt, Artificial Sequence
  derived and/or modified CDS sequence (wt) from DENV-1__GQ868511__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggauacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaaccuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuucaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucgcaggaaggagcaaugcacacugcguugacuggggcgacagaaauccagacgucaggaacgacaacaaucuuugcaggacaucugacaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcucuauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaaugggcaucaugauguuaaaauuauugacugaauuucagccacaccaguuauggaccaccuuacugucucugacauucauuaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgaucuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccagggaucauggaacacgggagaagaagugcaggugauagcuguugaaccaggaaaaaacccaaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagcuauaguccgugaggccauaaaaaagaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgcuacuuuuaccaugcgucucuuauccccagugagaguucccaauuacaacaugaucaucauggaugaagcacauuuuaccgauccagccagcauagcggccagaggguacaucucaacccgaguggguaugggugaggcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaacaaugaugaagaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggccacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacgccuacaaaaggaguggaauuauggagguggacagauccgaagccaaagagggacugaaaagaggagaaacaacuaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaaguuuuugggaucucgugcacaaagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggggguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5444 - RNA, 9879 nt, Artificial Sequence
  derived and/or modified CDS sequence (wt) from DENV-1__GQ868512__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugcuaaguucaagugugugacaaaacuagaaggaaagauaguucaauaugaaaaccuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccauugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaacaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucgucguggaugaacauuguggaaaucgagguccuucucucagaaccacaacagucacaggaaagauaauccaugaaugguguugcagauccugcacguuacccccccuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgcuacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgcgucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacacgccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaacuaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaaguguaguagaagcucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguucaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacauggggaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaucaagugagaaggcucaucgggaaugagaauuaucuagauuacaugacaucaaugaagagauucaagaaugagagugaucccgaaggggcacucugguga

SEQ ID NO: 5445 - RNA, 9879 nt, Artificial Sequence
  derived and/or modified CDS sequence (wt) from DENV-1__GU131970__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcaucgaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccucgaacagggcuggacuuuaaugagauggugcuauugacaaugaaagaaaaaucauggcuuguccacaaacaaugguuucuggacuuaccacugccuuggacuucgggggcuucaacaucccaagagaccuggaacagacaagauuugcuggucacauucaagacagcucaugcaaagaaacaggaaguggucguacugggaucacaggaaggagcaaugcacacugcgcugacuggggcgacagaaauccagacgucaggaacgacaacaaucuuugcaggacaucugaaaugcagacuaaaaauggauaaacugacuuuaaaagggacaucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacauugugguaggagcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugccaauggaauuuuggcccaagggaaaaaaacgauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguauuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuaccucccuuacguuucagaggagaagacggauguugguauggcauggaaaucagaccaguaaaggagaaggaggagaaucuaguuaggucaauggucucugcagguucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaagaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggauggacuugcaauggguaucaugauguuaaaauuauugacugaauuccauccacaccaguuauggaccaccuuacugucucugacauucaucaaaacaacucuaucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaagaaaaagcuggccccucaaugaaggaauuauggcuauuggaauaguuagcauucuacuaaguucacuccucaaaaaugaugugccguuggccggcccacuaauagcuggaggcaugcuaauagcauguuaugucauaucuggaagcucagccgauuuaucauuggagaaagcggcugaggugucuugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuucacacaauguggcacgucaccaggggagcuguccuuauguaccaagggaagaggcuggaaccaagcugggccaguguaaaaaaggauuugaucucauauggaggagguuggagguuucaaggaucauggaauacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagagucgucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacagauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagcuggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggagauagggaaacuuccacaacauuugacgcuaagagcccagaaugcucuagauaacuuggucauguugcacaauuccgaacaaggaggaaaagccuauagacaugccauggaggaacuaccagacaccauagaaacauugaugcuucuagcuuugauagcuguguugacugguggagugacgcuguuuuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauuuaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggccacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggaggcaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaagacaauccauacaaaacaugggccuaucauggaucauaugaggucaagccaucaggaucagccucaucuauggugaauggaguggugagauugcucacaaaaccaugggauguuauccccauggucacacaaauagcuaugaccgacaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuauaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggagggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacacgcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggaaguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugaaagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagacuauaugacaucaaugaagagauucaagaaugagagugaucccgaaggggcacucugguga

SEQ ID NO: 5446 - RNA, 9879 nt, Artificial Sequence
  derived and/or modified CDS sequence (wt) from DENV-1__KF955427__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaagcguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuggcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguggacuggggccacagaaauccagacgucaggaacgacaacaaucuuugcaggacauuugaaauggagacuaaaaauggauaaacugacuuuaaaagggacgucauaugugaugugcaccggcucauuuaagcuagagaaggaaguggcugagacucagcauggaacuggucuaguccaggucaaauacgaaggaacagacgcgccaugcaagauccccuuuuccgcccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaacugcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugaucaggccccaacccauggaacacaaauacucauggaaaagcuggggaaaagcuaaaaucauaggagcagacauacaaaauaccaccuucaucaucgacggcccagauaccccagaaugccccgacaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaggguaccacaguuguuguggaugaacauuguggaaaucgagguccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagccaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguugcccgacccacuaauagcaggaggcauccuaauagcauguuaugucauauccggaagcucagccgauuuaucauuggagaaagcggcugagauguccugggaacaagaggcagaacauuccgguaccucacacaacauacuaguagagguccaagaugaugguccuaugaaaauaaaagaugaagagagggaugacacacucacuauacuccuuaaagcaacuuugcuggcagucucaggaguguauccaaugucaauaccaggaacucuuuuugugugguacuuuuggcagaaaaagaaacagagaucaggaguguuaugggacacacccaguccuccgaaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuacuaugcgucucuuauccccagugagaguucccaauuacaacaugaucaucauggaugaagcacacuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguaucaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacagggugauagacccaaggcggugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaaguaucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccuacucugugugacggcuucaagcgcacuguuguggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuguuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaacacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcuaagaggaaaccaauucuguauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugacgaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgagguacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucgcaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5447 - RNA, 9879 nt, Artificial Sequence
  derived and/or modified CDS sequence (wt) from DENV-1__GQ868513__SS-prME
uccgugaccaugcuucucaugcugcugcccacagcccuggcguuccauuugaccacgcgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacggacacaugggugaccuaugggacguguucucaaaccggcgaacaccgacgagacaaacguuccguggcacuggccccacacgugggacuugguuuagaaacgagaaccgaaacauggauguccucugaaggcgccuggaagcaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcccacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccggucaacauugagacagaaccacccuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagggccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacaauuggauuaagcuugguggcaucuguggagcuaccaaauucuuuggaggagcuaggggauggacuugcaauggguaucaugauguuaaaauuauugacugaauuucagccacaccaguuauggaucaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcaggaggcaugcuaauagcauguuaugucauauccggaagcucagccgauuuaucauuggagaaagcggcugagguguccugggaacaagaggcagaacauucugguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguauuaugggacacacccagcccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaaugccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccaugguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagcccuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaaguuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaauaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggccacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaauuagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacaaacauacaaguggccauaaaccaagugagaaggcucaucgggaaugagaauuaucuagauuauaugacaucaaugaagagauucaagaaugagagugaucccgaaggggcacucugguga

SEQ ID NO: 5448 - RNA, 9879 nt, Artificial Sequence
  derived and/or modified CDS sequence (wt) from DENV-1__GU131973__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugcuaaguucaagugugugacaaaacuagaaggaaagauaguucaauaugaaaaccuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccauugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcucuaaaacuaagcugguucaagaaaggaagcagcauagggaaaauguucgaagcaaccgcccgaggagcacgaaggauggcuauucugggagacaccgcaugggacuuuggcuccauaggaggagucuucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaacaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuacccccccuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggccauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaaaugcguacguuaaucuuggcucccacaagaguugucgcuucugaaauggcagaggcgcucaagggaaugccaauaagauaucagacaacagcagugaagagugaacacacaggaagggagauaguugaccucaugugccacgcuacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgcgucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggagauagggaaacuuccacaacauuugacguuaagagcccagaaugcucuggauaacuuggucauguugcacaauuccgaacaaggaggaaaagccuauagacacgccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaacuaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaaguguaguagaagcucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguucaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacauggggaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaucaagugagaaggcucaucgggaaugagaauuaucuagauuacaugacaucaaugaagagauucaagaaugagagugaucccgaaggggcacucugguga

SEQ ID NO: 5449 - RNA, 9879 nt, Artificial Sequence
  derived and/or modified CDS sequence (wt) from DENV-1__GQ868517__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguucuguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuuuuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuuugacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucucagcacaacuauagaccaggguacuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagagguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuaugguacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccucaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaggauuugaucucauauggaggggguuggagguuucaaggaucauggaacacgggagaagaagugcaggugauagccguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuacuaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacaaagcaaugcaguuauccaagacgaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaacaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacguuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaauuacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggugccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5450 - RNA, 9879 nt, Artificial Sequence
  derived and/or modified CDS sequence (wt) from DENV-1__GU131976__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguucuguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugugugggaauaggcaacagagacuucguugaaggacugucaggagcaacguggguggacguaguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcucaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucucagcacaacuacagaccaggguacuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucacuaaugauugaagaagugaugagaucuagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccucaaaaaugaugugccguuggccggcccacugauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaagauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacuacggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaaaagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcaccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcucucugguga

SEQ ID NO: 5451 - RNA, 9879 nt, Artificial Sequence
  derived and/or modified CDS sequence (wt) from DENV-1__GQ868518__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauucaagcuagagaaggaaguggcugagacucagcauggaacuguucuagugcaggucaaauacgaaggaacagacgcgccaugcaagauccccuuuucgacccaagaugagaaaggggugacucagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaacugcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugaucaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaggguaccacagucguuguggaugaacauuguggaaaucgagguccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuacgcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccauuaauagcaggaggcaugcuaauagcauguuaugucauauccggaagcucagccgauuuaucauuggagaaagcggcugagguguccugggaacaagaggcagaacauucuggucccucacacaacauacuaguagagguccaagaugauggaacuaugaaaauaaaagaugaagagagggaugacacacucacuauacuccuuaaagcaacuuugcuggcagucucaggaguguauccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccgaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacacuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaacugagcagaaaaaccuuugacacugaguaccagaaaacaaaaaacaaugacugggacuauguugucacaacagacauuuccgaaaugggggcaaauuuccgggccgacagggugauagacccaaggcggugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagccuuuaaacaaugaugaggaccacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacgucaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccuacucugugugacggccucaagcgcacuguuguggauggccaguguggagccccauuggauagcggccuccauuauacuagaguucuuuuugauggugcugcuuauuccagagccagacagacagcgcacuccacaggacaaccagcuagcauauguggugauagguuuguuauucaugauacugacaguggcagccaaugagaugggauuguuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaacacaacggcaaacauuucccugacagccauugcaaaucaggcagcuauauugaugggacuugacaagggauggccaauaucgaagauggacauaggaguuccacuucucgccuuagggugcuauucccaagugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcuaagaggaaaccaauucuguauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugacgaggauaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgagguacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugcuacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucgcaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5452 - RNA, 9879 nt, Artificial Sequence
  derived and/or modified CDS sequence (wt) from DENV-1__GQ868519__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacggacacaugggugaccuaugggacguguucucaaaccggcgaacaccgacgagacaaacguuccguggcacuggccccacacgugggacuugguuuagaaacgagaaccgaaacauggauguccucugaaggcgccuggaagcaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagccaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuuugacccaagaugagaaaggggugacccagaaugggagauugauaacagccaaucccauagucacugacaaagaaaaaccggucaacauugagacagaaccacccuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaagcuggaauuggauuuugacuugugugaagguaccacagucguuguggaugaacauuguggaaaucgagggccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacaauuggauuaagcuugguggcaucuguggagcuaccaaauucuuuggaggagcuaggggauggacuugcaauggguaucaugauguuaaaauuauugacugaauuucagccacaccaguuauggaucaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcaggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguauuaugggacacacccagcccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaaugccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccaugguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagcccuuaaacaaugaugaggaucacgcucauuggacagaagcaaaaaugcuccucgacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaaguuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaauaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcucgcuuucuggaauucgaagcccuugguuucaugaaugaagaucacugguuuagcagagagaauucacucaguggaguggaaggagaaggacugcacaaacuuggauacauacucagagauauaucaaagauuccggggggaaauauguaugcagaugauacagccgguugggacacaagaauaacagaggaugaucuucagaaugaggcuaaaaucacugaaaucauggagccugaacaugcucuauuggccacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaauuagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacaaacauacaaguggccauaaaccaagugagaaggcucaucgggaaugagaauuaucuagauuauaugacaucaaugaagagauucaagaaugagagugaucccgaaggggcacucugguga

SEQ ID NO: 5453 - RNA, 9879 nt, Artificial Sequence
  derived and/or modified CDS sequence (wt) from DENV-1__KF955443__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguucuguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugugugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugcccuggacuucgggggcuucaacaucccaagagaccuggaacagacaagauuugcuggucacauucaagacagcucaugcaaagaaacaggaaguagucguacugggaucacaggaaggagcaaugcacacugcgcugacuggggcgacagaaauccagaugucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucggugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagucacgcgucuugagaacaucauguggaagcaaauaucaaaugaauugaaccacauucuacuugaaaaugacaugaaauucacagugguuguaggagaugcuaauggaauuuuggcucaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaagacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucucagcacaacuacagaccaggguacuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguccuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccucaaaaaugaugugccguuggccggcccacugauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuuuuaugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaagauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuggaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggacccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5454 - RNA, 9879 nt, Artificial Sequence
  derived and/or modified CDS sequence (wt) from DENV-1__GQ868520__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacggacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuggagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccggucaacauugagacagaaccacccuuuggugagagcuacaucgugguaggggcaggugaaaaagcuuuaaaacuaagcugguucaagaaaggaagcagcauagggaaaauguucgaggcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagggccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugauuugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccuaaaaaaugaugugccguuggccggcccacuaauagcaggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggaguuuuccaagauggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaaugccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcacccaggaucaggaaaaacaagaagauaucuuccagccaugguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagcccuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaaguuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaauaaaaaacccagaaucugcacaagagaggaguucacaagaaagguuaggucaaaugcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggccacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaauuagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaagaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaauggugcggaucccugauaggcuugacagcgagggccaccugggccacaaacauacaaguggccauaaaccaagugagaaggcucaucgggaaugagaauuaucuagauuauaugacaucaaugaagagauucaagaaugagagugaucccgaaggggcacucugguga

SEQ ID NO: 5455 - RNA, 9879 nt, Artificial Sequence
  derived and/or modified CDS sequence (wt) from DENV-1__GQ868522__SS-prME
uccgugaccaugcuucucaugcugcugcccacagcccuggcguuccauuugaccacacgaggaggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacggacacaugggugaccuaugggacguguucucaaaccggcgaacaccgacgagacaaacguuccguggcacuggccccacacgugggacuugguuuagaaacgagaaccgaaacauggauguccucugaaggcgccuggaagcaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucaacauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccggucaacauugagacagaaccacccuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagggccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacaauuggauuaagcuugguggcaucuguggagcuaccaaauucuuuggaggagcuaggggauggacuugcaauggguaucaugauguuaaaauuauugacugaauuucagccacaccaguuauggaucaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcaggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguauuaugggacacacccagcccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaaugccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccaugguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguaucaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagcccuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaaguuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaauaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggccacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaauuagcggagaugauugcguggugaaaccaauugacgacagguucgcuacagccuuaacagcccugaaugacaugggaaaaguaagaaaagacauaccgcagugggaaccuucaaaaggauggaaugauuggcagcaagcgccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacaaacauacaaguggccauaaaccaagugagaaggcucaucgggaaugagaauuaucuagauuauaugacaucaaugaagagauucaagaaugagagugaucccgaaggggcacucugguga

SEQ ID NO: 5456 - RNA, 9879 nt, Artificial Sequence
  derived and/or modified CDS sequence (wt) from DENV-1__HQ166036__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacucagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaacugcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugaucaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaggguaccacagucguuguggaugaacauuguggaaaucgagguccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuacgcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcaggaggcaugcuaauagcauguuaugucauauccggaagcucagccgauuuaucauuggagaaagcggcugagguguccugggaacaagaggcagaacauucugguaccucacacaacauacuaguagagguccaagaugauggaacuaugaaaauaaaagaugaagagagggaugacacacucacuauacuccuuaaagcaacuuugcuggcagucucaggaguguauccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccgaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacacuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaacugagcagaaaaaccuuugacacugaguaccagaaaacaaaaaacaaugacugggacuauguugucacaacagacauuuccgaaaugggggcaaauuuccgggccgacagggugauagacccaaggcggugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacgucaagagcccagaaugcucuggauaacuuggucauguugcacaauucugaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccuacucugugugacggccucaagcgcacuguuguggauggccaguguggagccccauuggauagcggccuccauuauacuagaguucuuuuugauggugcugcuuauuccagagccagacagacagcgcacuccacaggacaaccagcuagcauauguggugauagguuuguuauucaugauacugacaguggcagccaaugagaugggauuguuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaacacaacggcaaacauuucccugacagccauugcaaaucaggcagcuauauugaugggacuugacaagggauggccaauaucgaagauggacauaggaguuccacuucucgccuuagggugcuauucccaagugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcuaagaggaaaccaauucuguauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugacgaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgagguacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugcuacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucaccaauauggagguccaacuuauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucgcaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5457 - RNA, 9879 nt, Artificial Sequence
  derived and/or modified CDS sequence (wt) from DENV-1__GU131981__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacggacacaugggugaccuaugggacguguucucaaaccggcgaacaccgacgagacaaacguuccguggcacuggccccacacgugggacuugguuuagaaacgagaaccgaaacauggauguccucugaaggcgccuggaagcaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccggucaacauugagacagaaccacccuuuggugagagcuacaucaugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagggccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacaauuggauuaagcuugguggcaucuguggagcuaccaaauucuuuggaggagcuaggggauggacuugcaauggguaucaugauguuaaaauuauugacugaauuucagccacaccaguuauggaucaccuuacugucucugacauucaucaaaacaacucuuucauuggauuaugcauggaaaacaacggcuauggcacugucaaucguaucucucuuuccauuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcaggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguauuaugggacacacccagcccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaaugugcagacaaugccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccaugguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagcccuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggauagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaaguuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaauaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagauauaucaaagauuccggggggaaauauguaugcagaugauacagccgguugggacacaagaauaacagaggaugaucuucagaaugaggcuaaaaucacugaaaucauggagccugaacaugcucuauuggccacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaauuagcggagaugauugcguggugaaaccaauugacgacagguucgcuacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaagacaaaacucauguauccaguugggaagaaguuccauaccuagggaaaagggaagaucaaugguguggaucccugauaggcuugacagcgagggccaccugggccacaaacauacaaguggccauaaaccaagugagaaggcucaucgggaaugagaauuaucuagauuauaugacaucaaugaagagauucaagaaugagagugaucccgaaggggcacucugguga

SEQ ID NO: 5458 - RNA, 9879 nt, Artificial Sequence
  derived and/or modified CDS sequence (wt) from DENV-1__GQ868529__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacggacacaugggugaccuaugggacguguucucaaaccggcgaacaccgacgagacaaacguuccguggcacuggccccacacgugggacuuggucuagaaacgagaaccgaaacauggauguccucugaaggcgccuggaaacaaauacaaagaguggagacuugggcuuugagacacccaggauucacggugauagccuuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagacaguucaauaugaaaacuuaaaauauucggugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccggucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauuuacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaauagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcaggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagagguuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccaugguccgugaggccauaaaaagaaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagcccuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauguuagaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugacgcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggacuuggacaugaggaccccaucccaauggcgaccuauggcuggaaccuaguaaaguuacuggcuggaaaagauguauuuuuuaugccaccugagaaaugugacacccuucugugugauauuggggaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggccacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaauuagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacaaacauacaaguggccauaaaccaagugagaaggcucaucgggaaugagaauuaucuagauuauaugacaucaaugaagagauucaagaaugagagugaucccgaaggggcacucugguga

SEQ ID NO: 5459 - RNA, 9879 nt, Artificial Sequence
  derived and/or modified CDS sequence (wt) from DENV-1__GQ868531__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugcuaaguucaagugugugacaaaacuagaaggaaagauaguucaauaugaaaaccuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccauugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauacuuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaacaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuacccccccuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucuaacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgcuacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgcgucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacacgccauggaggaacuaccagacaccauagaaacauugaugcuucuagcuuugauagcuguguugacugguggagugacgcuguucuuccuaucaggaaaaggucuagggaaaacauccaucggccugcucuguguaacggccuccagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaacuaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaaguguaguagaagcucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguucaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacuuagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacauggggaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugucuaggcaagucauaugcacaaauguggcagcugauguacuuccacaggagagaccugagacuggcggcuaacgcuaucaguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaucaagugagaaggcucaucgggaaugagaauuaucuagauuacaugacaucaaugaagagauucaagaaugagagugaucccgaaggggcacucugguga

SEQ ID NO: 5460 - RNA, 9879 nt, Artificial Sequence
  derived and/or modified CDS sequence (wt) from DENV-1__GU131983__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcugguguaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacuaucaggagcaacguggguggacgugguauuggagcauggaagcugcgucaccaccauggcaaaaaauaaaccaaccuuggacauugaacucuugaagacggaggucacgaacccugccaucuugcgcaaacugugcauugaagcuaaaauaucaaacaccaccaccgacucaagauguccaacacaaggagaggccacauugguggaagaacaagacgcgaacuuugugugucgccgaacguuuguggacagaggcuggggcaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccauugccuuggacuucgggggcuucaacaucccaagagaccuggaacaggcaagauuugcuggucacauucaagacagcucaugcaaagaaacaggaaguagucguacugggaucgcaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcgaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugaaaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuagauuuugacuugugugaagguaccacagucguuguggaugaacauuguggaaaucgagguccuucucucagaaccacaacagucacaggaaagauaauccaugaaugguguugcagauccugcacgcuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugauuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgaucuaucauuggagaaagcggcugagguguccugggaacaagaggcagaacauuccgguaccucacacaacauacuaguagagguccaagacgauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaagugggaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaaggguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaggaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucauuccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacgcccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguuaauguuaguggcccauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauugaugaaaucuuuaggaggaggcaggagagguacgggagcucaaggggaaacacugggagagaaauggaaaagacaguuaaaccaacugagcaagucagaauucaacaccuauaaaaggaguggaauuauggagguggacagauccgaagcuaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcgaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaagaaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacacauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5461 - RNA, 9879 nt, Artificial Sequence
  derived and/or modified CDS sequence (wt) from DENV-1__GQ868532__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacggacacaugggugaccuaugggacguguucucaaaccggcgaacaccgacgagacaaacguuccguggcacuggccccacacgugggacuugguuuagaaacgagaaccgaaacauggauguccucugaaggcgccuggaagcaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccggucaacauugagacagaaccacccuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccugggcaaguuggaauuggauuuugacuugugugaagguaccacagucguuguggaugaacauuguggaaaucgagggccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacaauuggauuaagcuugguggcaucuguggagcuaccaaauucuuuggaggagcuaggggauggacuugcaauggguaucaugauguuaaaauuauugacugaauuucagccacaccaguuauggaucaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcaggaggcaugcuaauagcauguuaugucauauccggaaacucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguauuaugggacacacccagcccuccggaaguggaaagagcaguucuugaugauggcaucuauagaaucuugcaaagaggacuguugggcaggucccaaguaggagugggaguuuuccaagacggcguguuccauacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaaugccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccuccaccagagauugaggacgagguguuuaagaaaagaaacuuaacaauaauggaccugcauccaggaucaggaaaaacaagaagauaucuuccagccaugguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagcccuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuaacuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugagaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaaguuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaaaugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggaugguauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaauaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggccacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacaaacauacaaguggccauaaaccaagugagaaggcucaucgggaaugagaauuaucuagauuauaugacaucaaugaagagauucaagaaugagagugaucccgaaggggcacucugguga

SEQ ID NO: 5462 - RNA, 9879 nt, Artificial Sequence
  derived and/or modified CDS sequence (wt) from DENV-1__GQ868533__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuggcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauacgugaugugcacaggcucauuuaagcuagagaaggaaguggcugagacucagcauggaacuguucuagugcaggucaaauacgaaggaacagacgcgccaugcaagauccccuuuucgacccaagaugagaagggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguuuacaucugugggaaaauugguacaccagguuuuuggaacugcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugaucaggccacaacccauggaacacaaauacucauggaaaagcuggggaaaagcuaaaaucauagaagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaggguaccacagucguuguggaugaacauuguggaaaucgagguccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcaggaggcaugcuaauagcauguuaugucauauccggaagcucagcagauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguauccaaugucaauaccagcaacucuuuuuuugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcugucgaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaaaggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacacuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacagggugauagacccaaggcggugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacgucaagagcccagaaugcccuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccuacucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuguuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaacacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggacccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuagcaaagcuacacucuggaaaagauguauuuuuuaugccaccugagaaaugugacacucuucugugugauauuggugaguccucuccgaauccaacuauagaagaaggaagaacguuacguguucuaaaaaugguggaaccauggcuaagaggaaaccaauucuguauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugacgaggacaauccauacaaaacaugggccuaucauggaucauaugaggucaagucaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgagguacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucgcaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuauuuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaggaaguuccauaccuagggaaaagagaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5463 - RNA, 9879 nt, Artificial Sequence
  derived and/or modified CDS sequence (wt) from DENV-1__GQ868534__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugcuaaguucaagugugugacaaaacuagaaggaaagauaguucaauaugaaaaccuaaaauauucagugauagucacuguccacacaggggaccagcaccaggugggaaacgagacuacagaacauggaacaauugcgaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccauugccuuggacuucgggggcuucaacaucccaagagaccuggaacagacaggauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucguuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugccaauggaauuuuggcccaaggaaaaaaaaugauuaggccacaacccauggaacacaaauacucauggaaaagcuggggaaaagcuaaaaucauaggagcagacauacaaaacaccaccuucaucaucgacggcccagauaccccagaaugccccgauaaccaaagagcguggaacauuugggaaguugaggacuacggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuacccccccuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgcuacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgcgucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagaaugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacacgccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggauugaaaagaggagaaacaacuaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuauuccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaaguguaguagaagcucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguucaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacggccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcgaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagagcucuugacugguuggaaaaacauggcgccgaaaggcugaaaagaauggcaaucagcggagaugauugcguggugaaaccaauugacgacagguucgcuacagccuuaacagcccugaaugacauggggaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucguaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauacuuagggaaaagggaagaucaaugguguggaucccugauaggcuugacagcgagggccaccugggccacuaacauacaaguggccauaaaucaagugagaaggcucaucgggaaugagaauuaucuagauuacaugacaucaaugaagagauucaagaaugagagugaucccgaaggggcacucugguga

SEQ ID NO: 5464 - RNA, 9879 nt, Artificial Sequence
  derived and/or modified CDS sequence (wt) from DENV-1__GQ868535__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggugaacaccgacgagacaaacguucuguggcacuggccccacacgugggacuuggucuagaaacaagaaccgaaacauggaugucaucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugugugggaauaggcaacagagacuucguugaaggacugucaggagcaacguggguggacgugguauuggagcauggaagcugcgucacuaccauggcaaaaaauaaaccaaccuuggacauugaacucuugaagacggagguugcgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaauagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugaaacccagcauggaacuguucuagugcaggucaaauacgaaggaacagacgcgccaugcaagauccccuuuucaacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacacugcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcucaagguaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaagacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucucagcacaacuacagaccaggguacuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugacuggaacauuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccucaaaaaugaugugccguuggccggcccacugauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaagauuugaucucauauggaggggguuggagguuucaaggaucauggaacaugggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaagcuacacucuggaaaagauguauuuuuuaugccaccugagaaaugugacacccuucugugugacauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaucuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaaaguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggcuacauacucagagauauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugaugacagguucgcuacagccuuaacagcccugaaugacaugggaaaaguaagaaaagacauaccgcagugggaaccuucaaaaggauggaaugauuggcagcaagugccuuucuguucacaccauuuccaccaguugaucaugaaggaugggagggaaauaguggugccaugccgcaaccaagaugaacuugugggcagggcuagaguaucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5465 - RNA, 9879 nt, Artificial Sequence
  derived and/or modified CDS sequence (wt) from DENV-1__KJ189306__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggauauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguucacacuggggaccagcaccaggugggaaacgagacuacagaacauggaacaauugcgaccauaacaccucaagccccuacgucggaaauacagcugaccgacuacggagcccucacauuggauugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauuuaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaaggaacgucauaugugauguguacaggcccauuuaagcuagagaaggaaguggcugagacucagcauggaacuguucuagugcaggucaaauacgaaggaacagacgcgccaugcaagauccccuuuuugacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguaacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauacuccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucagcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguuggguuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgacuucccaaaaaacaacauggcuuccggugcuguuaggaucuuuuggaugcaaaccguuaacuauguuucuuauaacagaaaacaaaaucuggggaaggaaaaguuggccccuuaaugaaggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagagagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagauuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuugacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaacuacaacaugaucaucauggacgaagcacauuuuaccgauccagccagcauagcggccagaggguacaucucaacccgagugggcaugggugaagcagcugcgaucuucaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggacaacuuggucauguugcacaauuccgaacaaggaggaaaagccuauagacaugccauggaggaacuaccagacaccauagaaacauugaugcuucuagcuuugauagcuguguugacagguggagugacgcuguucuuccuaucaggaaaaggucuagggaaaacauccaucggccugcucugugugacggccucaagcgcacuguuguggauggccaguguggagccccauuggauagcagccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacuccuaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuacucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaauuaaaccaacugagcaagucagaauuccacaucuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccgauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguguuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagacaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucauaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaauucgaagcccucgguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgcugaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagcugucccaguugacugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5466 - RNA, 9879 nt, Artificial Sequence
  derived and/or modified CDS sequence (wt) from DENV-1__KJ189307__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauuuacggugauagccuuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaacaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauuuaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuugaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacauggcugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugcccugauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacuuuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacgacagucacaggaaagauaauccaugaaugguguugcagauccugcacguuacccccauuacguuucagaggagaagacggauguugguauggcauggaaaucagaccaguaaaggagaaggaggagaaucuaguuaggucaauggucucugcagggucaggagaaguggacaguuuuucauuaggaauacuauguguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguuggguuauuauuucgcagacuaacauccagggagguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcguggaaaacaacggcuauggcacugucaauuguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugagggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauaccaguagagguccaagaugauggaacuaugaaaauaaaagaugaagagagggaugacacacucacuauacuccuuaaagcaacuuuacuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccgggaaccuucaagacuccugaaggugaaguuggagccauagcucuagauuuuaaacccggcacaucuggaucucccaucgugaacagagagggaaaaauaguaggucuuuauggaaauggaguggugacaacaagugggaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucuccuauccccagugagaguucccaauuacaacaugaucaucauggaugaagcacauuuuaccgauccagccagcauagcggccagaggguacaucucaacccgagugggcaugggugaagcagcugcgaucuucaugacagccacucccccaggaucgguggaggccuuuccacagagcaaugcagucauccaagaugaggaaagagacauuccugagagaucauggaacucaggcuacgauuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaacaaugaugaggaucacgcucacuggacagaagcaaaaaugcuccuugacaauauaaacacaccagaagggaucaucccagcccucuuugagccagagagagaaaagaaugcagcaauagacggggaguacagacugcggggagaagcaagaaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacacuugacguuaagagcccagaaugcucuggacaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcgcuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguggacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacccuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggguacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaauaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaaguggcuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuauuuguucagcugucccaguugacugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5467 - RNA, 9879 nt, Artificial Sequence
  derived and/or modified CDS sequence (wt) from DENV-1__KJ189318__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguucuguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugugugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguuuagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccauauucuacuugaaaaugacaugaaauucacagugguuguaggagaugcuaauggaauuuuggcucaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaucggcuaaugucagcugccaucaaagacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucucagcacaacuacagaccaggguacuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacauuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugacuggaacacuggcugucuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcaauuggaauaguuagcauucuacuaaguucacuccucaaaaaugaugugccguuggccggcccacugauagcuggaggcaugcuaauagcauguuaugucauauccggaagcucagccgauuuaucauuggagaaaacggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaagauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuguccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauaggcaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugaugguguugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuauuuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaaucauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagagagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagagugucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaagacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5468 - RNA, 9879 nt, Artificial Sequence
  derived and/or modified CDS sequence (wt) from DENV-1__KJ189319__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguucuguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugcuauaggaacauccaucacucagaaagggaucauuuucauuuugcugaugcuggugacaccaucaauggccaugcgaugugugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcucaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucucagcacaacuacagaccaggguacuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucucuuggaugcaaaccguuaacuauguuucuuauaacagaaaacaaaaucuggggaaggaaaaguuggccccucaaugaaggaauuauggcuauuggaauaguuagcauucuacuaaguucacuccucaaaaaugaugugccguuggccggcccacugauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguacuuauguaccaagggaagaggcuggaaccaagcugggccagugucaaaaaagauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugccacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacagcuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacaucgugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5469 - RNA, 9879 nt, Artificial Sequence
  derived and/or modified CDS sequence (wt) from DENV-1__KJ189320__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguucuguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaaaugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguuuuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucucagcacaacuauagaccaggguacuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagagguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacucugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaggauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacacuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggcuacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuacggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggugccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacgaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5470 - RNA, 9879 nt, Artificial Sequence
  derived and/or modified CDS sequence (wt) from DENV-1__KJ189323__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaaugguuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauuuaagacagcucaugcaaagaaacaggaaguagucguacugggaucgcaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcccauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauacuccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguuggguuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaaggcggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggacgaagcacauuuuaccgauccagccagcauagcggccagaggguacaucucaacccgagugggcaugggugaagcagcugcgaucuuuaugacagccacucccccaggaucgguggaggccuuuccacagagcaaugcaguuauccaagaugaagaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauucaauugagcagaaaaaccuuugacacugaguaccagaaaacaaaaaauaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggacaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcagccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuacucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugagaugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuagagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaggccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcuaauguacuuccacaggagagaccugagacuggcggcuaacgcuaucuguucagcugucccaguugacugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5471 - RNA, 9879 nt, Artificial Sequence
  derived and/or modified CDS sequence (wt) from DENV-1__KJ189324__SS-prME
uccgugaccaugcuucucaugcugcugcccacagcccuggcguuccauuugaccacaagagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcugguguaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguagagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugagggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuucaaugagauggugcuauugacaaugaaagaaaaaucauggcuuguccacaaacaaugguuucuagacuuaccauugccuuggacuucgggggcuucaacaucccaagagaccuggaacaggcaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgagaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacgcuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuguuauuccgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgaucuaucauuggagaaagcggcugagguguccugggaacaagaggcagaacauuccgguaccucacacaacauacuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguacuuuuggcagaaaaagaaacagagaucaggaguguuaugggacacacccaguccuccugaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuugacaauaauggaccugcauccaggaucaggaaaaacaagaagauaucuuccagccauaguccgugaggccauaaaaaggaaacugcguacguuaaucuuggcucccacaaggguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucauuccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacaggcagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcccauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauugaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcgaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggccaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaagaaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5472 - RNA, 9879 nt, Artificial Sequence
  derived and/or modified CDS sequence (wt) from DENV-1__KJ189325__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacggacacaugggugaccuaugggacguguucucaaaccggcgaacaccgacgagacaaacguuccguggcacuggccccacacgugggacuuggucuagaaacgagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaccauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacacuaccaccgauucaagauguccaacacaaggagaggccacauugguggaagaacaagacgcgaacuuugugugccgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccggucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccacuuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacauuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaucaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcaggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguauuaugggacacacccagcccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaaugccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccaugguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagauccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagcccuuaaacaaugaugaggaucacgcucauuggacggaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaaguuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggccacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuugcccagcgaauuggaaacccccaaucuagcugagagaguucuugacugguuggaaaaacauggcgccgaaaggcugaaaagaauggcaauuagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacaaacauacaaguggccauaaaccaagugagaaggcucaucgggaaugagaauuaucuagauuauaugacaucaaugaagagauucaagaaugagagugaucccgaaggggcacucugguga

SEQ ID NO: 5473 - RNA, 9879 nt, Artificial Sequence
  derived and/or modified CDS sequence (wt) from DENV-1__KJ189326__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacggacacaugggugaccuaugggacguguucucaaaccggcgaacaccgacgagacaaacguuccguggcacuggccccacacgugggacuuggucuagaaacgagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaccauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacacuaccaccgauucaagauguccaacacaaggagaggccacauugguggaagaacaagacgcgaacuuugugugccgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccggucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccacuuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacauuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugaugcuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccuguccacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcaggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggauuauggaacacgggagaagaagugcaggugauagcuguugaaccaggaaaaaaccccaaaaauguacagacaacgccggguaccuucaagacuccugaaggugaaguuggagccauagcucuagauuucaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccaugguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagauccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagcccuuaaacaaugaugaggaucacgcucauuggacggaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcuaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaaguuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggccacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuugcccagcgaauuggaaacccccaaucuagcugagagaguucuugacugguuggaaaaacauggcgccgaaaggcugaaaagaauggcaauuagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacaaacauacaaguggccauaaaccaagugagaaggcucaucgggaaugagaauuaucuagauuauaugacaucaaugaagagauucaagaaugagagugaucccgaaggggcacucugguga

SEQ ID NO: 5474 - RNA, 9879 nt, Artificial Sequence
  derived and/or modified CDS sequence (wt) from DENV-1__KJ189327__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcaucgaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccucgaacagggcuggacuuuaaugagauggugcuauugacaaugaaagaaaaaucauggcuuguccacaaacaaugguuucuggacuuaccacugccuuggacuucgggggcuucaacaucccaagagaccuggaacagacaagauuugcuggucacauucaagacagcucaugcaaagaaacaggaaguggucguacugggaucacaggaaggagcaaugcacacugcgcugacuggggcgacagaaauccagacgucaggaacgacaacaaucuuugcaggacaucugaaaugcagacuaaaaauggauaaacugacuuuaaaagggacaucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacauugugguaggagcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugccaauggaauuuuggcucaagggaaaaagaugauuaggccacaacccauggaacacaaauacucauggaaaagcuggggaaaagcuaaaaucauaggagcagacacacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucccagcacaacuacagaccaggguacuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccucccuuacguuucagaggagaagacggauguugguauggcauggaaauuagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuacuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuaauaacagaaaacaaaaucuggggaaggaaaaguuggccccucaaugaaggaauuauggcuauuggaauaguuagcauucuacuaaguucacuccucaaaaaugaugugccguuggccggcccacugauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaaccaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaagauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagcugguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagccuugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5475 - RNA, 9879 nt, Artificial Sequence
  derived and/or modified CDS sequence (wt) from DENV-1__KJ189328__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcaucgaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccucgaacagggcuggacuuuaaugagauggugcuauugacaaugaaagaaaaaucauggcuuguccacaaacaaugguuucuggacuuaccacugccuuggacuucgggggcuucaacaucccaagagaccuggaacagacaagauuugcuggucacauucaagacagcucaugcaaagaaacaggaaguggucguacugggaucacaggaaggagcaaugcacacugcgcugacuggggcgacagaaauccagacgucaggaacgacaacaaucuuugcaggacaucugaaaugcagacuaaaaauggauaaacugacuuuaaaagggacaucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacauugugguaggagcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugccaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguauuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuaccucccuuacguuucagaggagaagacggauguugguauggcauggaaaucagaccaguaaaggagaaggaggagaaucuaguuaggucaauggucucugcagguucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaagaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggauggacuugcaauggguaucaugauguuaaaauuauugacugaauuccauccacaccaguuauggaccaccuuacugucucugacauucaucaaaacaacucuaucauuggacuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaagaaaaagcuggccccucaaugaaggaauuauggcuauuggaauaguuagcauucuacuaaguucacuccucaaaaaugaugugccguuggccggcccacuaauagcuggaggcaugcuaauagcauguuaugucauaucuggaagcucagccgauuuaucauuggagaaagcggcugaggugucuugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuucacacaauguggcacgucaccaggggagcuguccuuauguaccaagggaagaggcuggaaccaagcugggccaguguaaaaaaggauuugaucucauauggaggagguuggagguuucaaggaucauggaauacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagagucgucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacagauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagcuggaccgaugccagugacuguggccagugcugcccagaggagaggaagaauuggaaggaaccaaaacaaggaaggugaccaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccaggacauacucugauccauuggcccugcgcgaguuuaaagaguuugcagcaggaagaagaagugucucaggugaccuaauauuggagauagggaaacuuccacaacauuugacgcuaagagcccagaaugcucuagauaacuuggucauguugcacaauuccgaacaaggaggaaaagccuauagacaugccauugaggaacuaccagacaccauagaaacauugaugcuucuagcuuugauagcuguguugacugguggagugacgcuguuuuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauuuaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggccacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggaggcaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaagacaauccauacaaaacaugggccuaucauggaucauaugaggucaagccaucaggaucagccucaucuauggugaauggaguggugagauugcucacaaaaccaugggauguuauccccauggucacacaaauagcuaugaccgacaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuauaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggagggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacacgcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggaaguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugaaagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagacuauaugacaucaaugaagagauucaagaaugagagugaucccgaaggggcacucugguga

SEQ ID NO: 5476 - RNA, 9879 nt, Artificial Sequence
  derived and/or modified CDS sequence (wt) from DENV-1__KJ189329__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacgcaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagccuuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauacgugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaacugcauaugggguucuguucagugguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugaucaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaucaggguauuucacacaaacagcagggccauggcaccuaggcaaguuggaauuggauuuugacuugugugaggguaccacagucguuguggaugaacauuguggaaaucgagguccuucucucagaaccacaacagucacaggaaagauaauccaugaaugguguugcagauccugcacguuaccucccuuacguuucagaggagaagacggauguugguauggcauggaaaucagaccaguaaaggagaaggaggagaaucuaguuaggucaauggucucugcagggucaggagaaguggacaguuuuucauuaggaauacugugcgcaucaauaaugauugaagaagugaugagauccagauggaguagaaagaugcugaugacuggaacgcuggcuguuuuccuccuucuuguaaugggacaacugacauggaaugaucugauuaggcuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaauuguaucucucuuuccuuuaugccugucuacgaccucccaaaaaaccacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcaggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguauccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagacgauaucuuccagccauaguccgugaggccauaaaaaggaaacugcgcacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgccucuuauccccagugagaguucccaauuacaacaugaucaucauggaugaagcacacuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguaucaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaacuuccgggccgacagggugauagacccaaggcggugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacgucaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccuacucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuguuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaacacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcuaagaggaaaccaauucuguauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugacgaggacaauccauacagaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgagguacaacacaaauuauggaggugacagccaagugguuaugggguuuccuuuccagaaacaaaaaacccagaaucugcacaagagaggaguucacaagaaagguuaggucaaaugcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgauagguucgcuacagccuuaacagcccugaaugacaugggaaaaguaagaaaagacauaccgcagugggaaccuucaaaaggauggaaugauuggcagcaagugccuuucuguucgcaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5477 - RNA, 9879 nt, Artificial Sequence
  derived and/or modified CDS sequence (wt) from DENV-1__KJ189331__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguucuguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugauguuggugacaccaucaauggccaugcgaugugugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccauaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguuuagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccauauucuacuugaaaaugacaugaaauucacagugguuguaggagaugcuaauggaauuuuggcucaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaucggcuaaugucagcugccaucaaagacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucucagcacaacuacagaccaggguacuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacauuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugauuggaacacuggcugucuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcaauuggaauaguaagcauucuacuaaguucacuccucaaaaaugaugugccguuggccggcccacugauagcuggaggcaugcuaauagcauguuaugucauauccggaagcucagccgauuuaucauuggagaaaacggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaagauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuguccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggccauguugcauaauuccgaacaaggaggaaaagccuauaggcaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugaugguguugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuauuuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaucucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaaucauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagagagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagagugucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaagacccauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5478 - RNA, 9879 nt, Artificial Sequence
  derived and/or modified CDS sequence (wt) from DENV-1__KJ189332__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguucuguggcacuggccccacacgugggacuuggucuagaaacaagaaccgaaacauggauguccucugaaggcgccuggaaacaaauacaaagaguggagacuugggcuuugagacacccaggauucacggugauagcucuuuuuuuagcacaugccauaggaacauccaucacucagaaagggaccauuuucauuuugcugaugcuggugacaccaucaauggccaugcgaugugugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauuaacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguuuagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccauauucuacuugaaaaugacaugaaauucacagugguuguaggagaugcuaauggaauuuuggcucaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaucggcuaaugucagcugccaucaaagacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucucagcacaacuacagaccaggguacuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacauuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugacuggaacacuggcugucuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcaauuggaauaguaagcauucuacuaaguucacuccucaaaaaugaugugccguuggccggcccacugauagcuggaggcaugcuaauagcauguuaugucauauccggaagcucagccgauuuaucauuggagaaaacggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaagauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguugaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuguccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuugagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggccauguugcauaauuccgaacaaggaggaaaagccuauaggcaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugaugguguugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuauuuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaucucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaaucauggagguaacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagagagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagagugucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaagacccauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5479 - RNA, 9879 nt, Artificial Sequence
  derived and/or modified CDS sequence (wt) from DENV-1__KJ189334__SS-prME
uccgugaccaugcuucucaugcugcugcccacagcccuggcguuccauuugaccacacgagggggagagccacacaugauaguuaguaagcaggaaagaggaaagucacucuuguuuaaggucucugcaggugucaauaugugcacucucauugcgauggacuugggagaguugugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagccuuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugcuaaguucaagugugugacaaaacuagaaggaaagauaguucaauaugaaaaccuaaaauauucagugauagucacuguccacacaggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccauugccuuggacuucgggggcuucaacaucccaagagaccuggaacagacaggauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucguuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugccaauggaauuuuggcccaaggaaaaaaaaugauuaggccacaacccauggaacacaaauacucauggaaaagcuggggaaaagcuaaaaucauaggagcagacauacaaaacaccaccuucaucaucgacggcccagauaccccagaaugccccgauaaccaaagagcguggaacauuugggaaguugaggacuacggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuacccccccuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacuaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgcuacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgcgucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagaaugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacacgccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcaguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaacuaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuauuccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaaguguaguagaagcucuggagcaaaugcaaagaaaacauggagggaugcuagugcgaaacccacucucaagaaauuccacccaugaaauguacuggguuucauguggaacaggaaacauugugucggcagugaacaugacauccagaauguugcugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguucaaagagaaaguugacacgcgcacaccaagagcaaaacgaggcacaacacaaauuauggaggugacagccaagugguuaugggguuuccuuuccagaaauaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacggccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacauggggaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucguaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauacuuagggaaaagggaagaucaaugguguggaucccugauaggcuugacagcgagggccaccugggccacuaacauacaaguggccauaaaucaagugagaaggcucaucgggaaugagaauuaucuagauuacaugacaucaaugaagagauucaagaaugagagugaucccgaaggggcacucugguga

SEQ ID NO: 5480 - RNA, 9879 nt, Artificial Sequence
  derived and/or modified CDS sequence (wt) from DENV-1__KJ189335__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguugugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagccuuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugcuaaguucaagugugugacaaaacuagaaggaaagauaguucaauaugaaaaccuaaaauauucagugauagucacuguccacacaggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccauugccuuggacuucgggggcuucaacaucccaagagaccuggaacagacaggauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucguuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugccaauggaauuuuggcccaaggaaaaaaaaugauuaggccacaacccauggaacacaaauacucauggaaaagcuggggaaaagcuaaaaucauaggagcagacauacaaaacaccaccuucaucaucgacggcccagauaccccagaaugccccgauaaccaaagagcguggaacauuugggaaguugaggacuacggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuacccccccuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacuaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgcuacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgcgucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagaaugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacacgccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcaguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaacuaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuauuccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaaguguaguagaagcucuggagcaaaugcaaagaaaacauggagggaugcuagugcgaaacccacucucaagaaauuccacccaugaaauguacuggguuucauguggaacaggaaacauugugucggcagugaacaugacauccagaauguugcugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguucaaagagaaaguugacacgcgcacaccaagagcaaaacgaggcacaacacaaauuauggaggugacagccaagugguuaugggguuuccuuuccagaaauaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacggccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacauggggaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucguaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauacuuagggaaaagggaagaucaaugguguggaucccugauaggcuugacagcgagggccaccugggccacuaacauacaaguggccauaaaucaagugagaaggcucaucgggaaugagaauuaucuagauuacaugacaucaaugaagagauucaagaaugagagugaucccgaaggggcacucugguga

SEQ ID NO: 5481 - RNA, 9879 nt, Artificial Sequence
  derived and/or modified CDS sequence (wt) from DENV-1__KJ189336__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacccagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccacugauucaagauguccaacacaaggagaggccacauugguggaagaacaagacgcgaacuuugugugucgccgaacguuuguggacagaggcugggguaauggcuguggacuauucggaaagggaagccuauugacgugugcuaaguucaagugugugacaaaacuagaaggaaagauaguucaauaugaaaaccuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccauugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcauuguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaacaccaccuucaucauugacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuacccccccuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauacggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgcuacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgcgucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaguugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacacgccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugagaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaacuaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguguuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaaguguaguagaagcucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguucaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacauggggaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaucaagugagaaggcucaucgggaaugagaauuaucuagauuacaugacaucaaugaagagauucaagaaugagagugaucccgaaggggcacucugguga

SEQ ID NO: 5482 - RNA, 9879 nt, Artificial Sequence
  derived and/or modified CDS sequence (wt) from DENV-1__KJ189337__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguagauugcuggugcaaugccacagacacaugggugaccuaugggacguguucucaaaccggcgaacaccgacgagacaaacguucuguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugugugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauuaacaaugaaagaaaaaucauggcuuguccacaaacaaugguuucuagacuuaccacugccuuggacuucgggggcuucaacaucccaagagaucuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaauuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcucaagggaaaaaaaugauuagaccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguacuucacacaaacagcagggccauggcaccuaggcaaguuggaauuggauuuugacuugugugaagguaccacagucguuguggaugaacauuguggaaaucgagguccuucucucagaacuacaacaguuacaggaaagauaauccaugaaugguguugcagauccugcacguuacccccuuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccuguccacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccucaaaaaugaugugccguuggccggcccacugauagcuggaggcaugcugauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaggaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaggauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagauauucccgagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuagucauguugcacaauuccgaacaaggaggaaaagccuauagacaugccauggaggaacuaccagacaccauagaaacauugaugcuucuagcuuugauagcuguguugacugguggagugacgcuguucuucuuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccucaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuaggguguuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaccuagauaucauuggccagaggauagagaauguaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucguacacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5483 - RNA, 9879 nt, Artificial Sequence
  derived and/or modified CDS sequence (wt) from DENV-1__KJ189340__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugcuaaguucaagugugugacaaaacuagaaggaaagauaguucaauaugaaaaccuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccauugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaacaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuacccccccuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauacggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacagguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgcuacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgcgucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaguugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacacgccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgcuuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugagaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaacuaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguguuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaaguguaguagaagcucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguucaaagagaaaguugacacgcgcacaccaaaagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacauggggaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaucaagugagaaggcucaucgggaaugagaauuaucuagauuacaugacaucaaugaagagauucaagaaugagagugaucccgaaggggcacucugguga

SEQ ID NO: 5484 - RNA, 9879 nt, Artificial Sequence
  derived and/or modified CDS sequence (wt) from DENV-1__KJ189341__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucaucgcgauggacuugggagaguuaugugaggacacaaugaccuacaaaugcccccagaucacugaggcggaaccagaugacguugacugcuggugcaacgccacagacacaugggugaccuaugggacguguucucaaaccggcggacaccgacgagagaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacacgccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccgucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccucgaacagggcuggacuucaaugagauggugcuauugacaaugaaagaaaaaucauggcuuguccacaaacaaugguuucuggacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugaccuuaaaagggacgucauaugugaugugcacaggcccauuuaagcuagagaaggaaguggcugagacccagcauggaacuguucuagugcaggucaaauacgaaggaacagacgcgccaugcaagauccccuuuucgacccaagaugagaaaggagugacccagaaugggagacugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauuguaguuggcauaguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacacacaaaauaccaccuucaucaucgacggcccagauaccccagaaugccccgauaaccaaagagcauggaacaucugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguauuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaagaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccuguccacgaccucccaaaaaacaacauggcuuccggugcuguuaggaucuuuuggaugcaaaccgucaacuauguuucuuauaacagaaaacaaaaucuggggaagaaaaagcuggccccucaaugaaggaauuauggcuauuggaauaguuagcauucuacuaaguucacuccucaaaaaugaugugccguuggcuggcccacuaauagcuggaggcaugcuaauagcauguuaugucauaucuggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuucacacaauguggcacgucaccaggggagcuguccuuauguaccaagggaagaggcuggaaccaagcugggccaguguaaaaaaggauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauuuuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguauccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcucugauagcuguguugacugguggagugacgcuguucuuccuaucaggaaaaggucuagggaaaacauccaucggccugcucugugugacggccucaagcgcacugcuguggauggccaguguggagcuccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacccucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaucuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucuuguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgacaccacacccuuuggacaacagagaguguuuaaagagaagguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuauaacaugauggggaagagagagaaaaaacuaggagaguuugggaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccggcugggacacaagaauaacagaggaugaucuucagaaugaggcuaaaaucacugacauuauggagccugaacaugcucuauuggcuacgucaaucuuuaagcugacuuaucaaaacaaaguggugagggugcaaagaccagcaaaaaacggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggaaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5485 - RNA, 9879 nt, Artificial Sequence
  derived and/or modified CDS sequence (wt) from DENV-1__KJ189343__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaacaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugacagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugcuaaguuuaagugugugacaaaacuagaaggaaagauaguucaauaugaaaaccuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccauugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaauugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagcuaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguagucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaucggcuaaugucagcugccaucaaagacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucucagcacaacuacagaccaggguacuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacauuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugauuggaacacuggcugucuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcaauuggaauaguaagcauucuacuaaguucacuccucaaaaaugaugugccguuggccggcccacugauagcuggaggcaugcuaauagcauguuaugucauauccggaagcucagccgauuuaucauuggagaaaacggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggggcuguccuuauguaccaagggaagaggcuggaaccaagcugggccagugucaaaaaagauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuguccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguaucaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcgaaaaugcuccuugauaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggccauguugcauaauuccgaacaaggaggaaaagccuauaggcaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugaugguguugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacagucaucacucccaugaugagacacacaauugaaaauacaacggcaaacauuucccugacagccauugcaaaucaggcagcuauauugaugggacuugacaaaggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagauuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuauuuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaucucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauuugaaagagacguggacuuaggcgcuggaacaaggcauguggcaguggaaccagagguagccaaucuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaaucauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagagagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagagugucacaaggagccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaagacccauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5486 - RNA, 9879 nt, Artificial Sequence
  derived and/or modified CDS sequence (wt) from DENV-1__KJ189344__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaacaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugacagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugcuaaguuuaagugugugacaaaacuagaaggaaagauaguucaauaugaaaaccuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccauugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaauugacuuuaaaagggacgucauaugugaugugcacaggcucauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagcuaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguagucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaacacuaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuacccccccuacgcuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaaugggcaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugacgugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgcuacuuuuaccaugcgucucuuauccccagugagaguucccaauuacaacaugaucaucauggaugaagcacauuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgcgucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaucagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggauaacuuggucauguugcacaauuccgaacaaggaggaaaagccuauagacacgccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagcuacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuggcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaacuaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaaguguaguagaagcucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguucaaagagaaaguugacacgcgcacaccaagagcaaaacgaggcacaacacaaauuauggaggugacagccaagugguuauggggguuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacauggggaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccauaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaucaagugagaaggcucaucgggaaugagaauuaucuagauuacaugacaucaaugaagagauucaagaaugagagugaucccgaaggggcacucugguga

SEQ ID NO: 5487 - RNA, 9879 nt, Artificial Sequence
  derived and/or modified CDS sequence (wt) from DENV-1__KJ189346__SS-prME
uccgucaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuggcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggggaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccaacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagaugucaggaacgacaacaaucuuugcaggacaucugaaaugcagacuaaaaauggauaaacugacuuuaaaagggacgucauacgugaugugcacaggcucauuuaagcuagagaaggaaguggcugagacucagcauggaacuguucuggugcaggucaaauacgaaggaacagacgcgccaugcaagauccccuuuucgacccaagaugagaagggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguuuacaucugugggaaaauugguacaccagguuuuuggaacugcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugaucaggccacaacccauggaacacaaauacucauggaaaagcuggggaaaagcuaaaaucauaggagcagacauacaaaauaccaccuucaucaucgacggcccagauaccccagaaugccccgauaaccagagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuauggaaagugaaaugauaaucccaaagauauauggaggaccaauaucucagcacaacuauagaccaggguauuucacacaaacagcagggccauggcaccuaggcaaguuggaauuggauuuugacuugugugaggguaccacagucguuguggaugaacauuguggaaaucgagguccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauugggaauacuaugcgcaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcaggaggcaugcuaauagcauguuaugucauauccggaagcucagcagauuuaucauuggagaaagcggcugagguguccugggaacaagaggcagaacauuccgguaccucacacaacauacuaguagagguccaagaugauggaacuaugaaaauaaaagaugaagagagggaugauacacucacuauacuccuuaaagcaacuuugcuggcagucucaggaguguauccaaugucaauaccagcaacucuuuuuuugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccagaggagcuguccuuauguaccaagggaagaggcuggaaccaagcugggccagugucaaaaaggauuugaucucauauggaggagguuggagguuccaaggaucauggaacacgggagaagaagugcaggugauagcugucgaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaaaggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacacuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacagggugauagacccaaggcggugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacgucaagagcccagaaugcccuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccuacucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuguuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaacacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggacccugugguuuaugaugcaaaauuugaaaaacagcuaggccaaauaauguuacugauacuuuguacaucacagauccucuugaugcggaccacgugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuagcaaagcuacacucuggaaaagauguauuuuuuaugccaccugagaaaugugacacucuucugugugauauuggugaguccucuccgaauccaacuauagaagaaggaagaacguuacguguucuaaaaaugguggaaccauggcuaagaggaaaccaauucuguauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaacggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugacgaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgagguacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauacugcagugggaaccuucaaaaggauggaaugauuggcagcaagugccuuucuguucgcaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuauuuguucagccgucccaguugauugggucccaaccagccgcacaaccuggucaauccaugcccaccaccaauggaugacaacagaagacauguuaucaguauggaauaggguuuggauagaggaaaacccauggauggaggacaaaacucauguauccaguugggaggaaguuccauaccuagggaaaagagaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5488 - RNA, 9879 nt, Artificial Sequence
  derived and/or modified CDS sequence (wt) from DENV-1__KJ189347__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaaugguuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauuuaagacagcucaugcaaagaaacaggaaguagucguacugggaucgcaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcccauuuaagcuagagaaggaaguggcugagacucagcauggaacuguucuagugcaggucaaauacgaaggaacagacgcgccaugcaagauccccuuuuugacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacauccgugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauacuccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaaggaaccacagucguuguggaugaacauuguggaaaucgaggcccuucucucagaaccacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaacgcuucagacaggauggggaugggaacaacguaccuagccuugauggcuacuuucaaaaugagaccaauguucgcuguuggguuauuauuucgcagacuaacauccagagaaguucuucuucucacgauuggauuaagcuugauggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucucucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccauuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaaccuggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggacgaagcacauuuuaccgauccagccagcauagcggccagaggguacaucucaacccgagugggcaugggugaagcagcugcgaucuuuaugacagccacucccccaggaucgguggaggccuuuccacagagcaaugcaguuauucaagaugaagaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauucaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcguguuauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggacaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcagccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuacucccaggugaacccauugacacugacagcggcgguguugauguuaguggcucauuaugccauaaucggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugagaugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaggccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaagaugugccacgugugucuacaacaugauggggaagagagagaaaaaacuaggagaguuuggaaaggcaaaaggaagccgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcuaauguacuuccacaggagagaccugagacuggcggcuaacgcuaucuguucagcugucccaguugacugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucggaaaugagaauuaucuagauuauaugacaucaaugaagagauucaagaaugagagugaucccgaaggggcacucugguga

SEQ ID NO: 5489 - RNA, 9879 nt, Artificial Sequence
  derived and/or modified CDS sequence (wt) from DENV-1__KJ189348__SS-prME
uccgugaccaugcuccucaugcugcugcccacagcccuggcauuccauuugaccacacgggggggagagccacacaugauaguuaguaagcaugaaagaggaaagucacucuuguuuaagacuucugcaggugucaacaugugcacucucauugcgauggacuugggagaguuaugugaggacacaaugaccuacaaauguccccggauuacugaggcggaaccagaugacguugacugcuggugcaaugccacagacacaugggugaccuaugggacguguucucaaaccggcgaacaccgacgagacaaacguuccguggcacuggccccgcacgugggacuuggucuagaaacaagaaccgaaacauggauguccucugaaggcgccuggaaacaaauacaaagaguggagacuugggcuuugagacacccaggauucacggugauagcccuuuucuuagcacaugccauaggaacauccaucacucagaaagggaucauuuucauuuugcuaaugcuggugacaccaucaauggccaugcgaugcgugggaauaggcaacagagauuucguugaaggacugucaggagcaacguggguggacguaguauuggagcauggaagcugcgucaccaccauggcaaaaaauaaaccaaccuuggacauugaacucuugaagacggaggucacgaacccugccgucuugcgcaaacugugcauugaagcuaaaauaucaaacaccacuaccgauucaagauguccaacacaaggagaggcuacacugguggaagaacaagacgcgaacuuugugugucgccgaacguuuguggacagaggcugggguaaugguugcggacuauucggaaagggaagccuauugacgugugccaaguucaagugugugacaaaacuagaaggaaagauaguucaauaugaaaacuugaaauauucagugauagucacuguccacacuggggaccagcaucaggugggaaacgagacuacagaacauggaacaauugcaaccauaacaccucaagcuccuacgucggaaauacagcugacugacuacggagcccucacauuggacugcucaccuagaacagggcuggacuucaaugagauggugcuauugacaaugaaagaaaaaucauggcuuguccacaaacaaugguuucuagacuuaccacugccuuggacuucgggggcuucaacaucucaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacacuugaaaugcagauuaaaaauggauaaacugacuuuaaaggggacgucauaugugaugugcacaggcucauuuaaguuagagaaggaaguggcugagacccaacauggaacuguucuagugcaggucaaauacgaaggaacagacgcgccaugcaagauccccuuuucgacccaagaugagaaaggagugacccagaauggaagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauaggaaaaauguucgaagcaacugcccgaggagcacgaaggauggcuauccugggagacaccgcaugggacuucggcucuauaggaggaguguucacaucuguaggaaaauugguacaccagguuuuuggaaccgcauaugggguucuguucagcgguguuucuuggaccaugaaaauaggaauagggauucugcugacaugguugggauuaaauucaaggagcacgucauuuucaaugacgugcauugcaguuggcaugguaacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgaugaccaaagagcguggaacauuugggaagucgaggacuauggguuuggaaucuucacgacuaacauauggcugaaauugcgugacuccuacacccaaaugugugaccaccggcuaaugucagcugccaucaaggacagcaaggcaguccaugcugacaugggguacuggauagaaagugaaaagaacgaaaccuggaaguuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaacuggauuuugacuugugugaagguaccacaguuguuguggaugaacauuguggaaaucgaggcccaucucucagaacuacaacggucacaggaaagauaauccaugaaugguguugcagauccugcacguuaccccccuuacgcuucagaggagaagacggauguugguauggcauggaaaucagaccaguaaaggagaaggaggagaaucuaguuaggucgauggucucugcagggucaggagaaguggacaguuuuucacugggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggccacuuucaaaaugagaccaauguucgcuguugggauauuguuucgcagacuaacauccagagaaguucuucuucucacgauuggauuaagccugguggcauccguagagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggcccaucaaugaaggaauuauggcuauuggaauagucagcauucuacugaguucacuccucaaaaaugaugugccguuggccgggccacuaauagcuggaggcaugcuaauagcauguuacgucauauccggaagcucagccgauuuaucauuggagaaagcggcugagguguccugggaacaagaagcagaacacucagguaccucacacaacauauuaguagagguccaagaugauggaacuaugagaauaaaagaugaagagaaggaugacacacucacuauacuccuuaaggcaacuuugcuggcagucucaggaguguacccaaugucaauaccagcaacucuuuuugugugguauuucuggcagaaaaagaaacagagaucaggaguguuaugggacacacccagcccuccggaaguggaaagagcaguucuugaugauggcaucuauagaaucuugcaaagaggacuguugggcagaucccaagugggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaagucggagcuauagcucuagauuuuaaacccggcacaucuggaucucccaucgugaacagagagggaaaaauaguaggucuuuauggaaauggaguggugacaacaaguggaaccuacgucagugccauugcucaagcuaaagcaucacaggaagggccucuaccagagauugaggacgagguguucaagaaaagaaacuuaacaauaauggaccugcauccaggaucaggaaaaacaaggagauaucuuccggccauaguccgugaggccauaaaaaggaagcugcguacguuaaucuuggcucccacaagaguugucgccucugaaauggcagaggcgcucaagggaaugccaauaagauaucagacaacagcagugaagagugaacacacaggaagggagauaguagaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguagaggccuuuccacagaguaaugcaguuauccaagaugaggaaagagacauucccgagagaucauggaacucaggcuacgacuggaucacugauuuuccagguaaaacagucugguuugucccaagcauuaaaucaggaaaugacauugccaacuguuuaagaaagaacggaaaacggguaauccaauugagcagaaaaaccuuugacacugaguaccaaaaaacaaaaaacaaugauugggacuaugucgucacaacagacauuuccgaaaugggggcaaauuuccgggcugacaggguaauagacccaaggcggugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagccuuugaacaacgaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacucggacagaagguggugcuuugauggggaaaggaacaaccagguguuggaggagaacauggacguggagauuuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacacuugacgcugagagcccagaaugcucuggauaacuuggucauguugcacaauuccgaacaaggaggaaaagccuacagacaugcuauggaggaacuaccagacaccauagaaacauugaugcuuuuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuucuugaugguguugcucauuccagagccagacagacagcgcacuccacaggacaaccagcuagcauauguggugauagguuuguuauucaugauacugacaguggcagccaaugagaugggauuauuggaaaccacaaagagagaccuggggauuggccauguggccgccgaaaaccaccaacaugccacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggagucccacuucucgccuuagggugcuauucccaggugaacccauugacacugacagcggcaguguugauguuaguggcucauuaugccauaauuggaccaggacugcaagcaaaggccacuagagaagcucaaaaaaggacagcggccggaauaaugaaaaauccaacuguagacgggauuguugcuauagacuuggauccugugguuuaugaugcaaaauuugaaaaacagcuaggccaaauaaugcuacugauacuuuguacaucacaaauucucuuaaugcggaccacaugggccuugugugaauccaucacacuggcgacuggaccccugaccacucucugggagggaucuccaggaaaauucuggaauacaacgauagcaguguccauggcaaacaucuucaggggaaguuaucuagcaggagcaggucuggcuuucucauugaugaaaucuuuaggaggagguaggagagguacgggagcucaaggggaaacacugggagagaaauggaaaagacaguuaaaccaacugagcaagccagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaagggaaagucauagaccucgguuguggaagggguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuuuugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaauauugugucggcagugaacaugacauccagaauguuacugaaucgauucacaauggcucacaggaagccaacauaugaaagagacguggauuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuaugguaaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguugugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcauagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacaucaauuuuuaagcugaccuaucaaaauaagguggugagggugcaaagaccagcaaaaaauggaaccgugauggauguuauaucuagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuuaacugguuggaaaaacauggcgccgaaaggcugaaaagaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuucaccagcugaucaugaaggaugggagggaaauaguggugccaugccgcaaccaagaugagcuuguaggcagggcuagaguaucacaaggcgccggauggagccugagagaaacugcuugccuaggcaagucauaugcacaaauguggcaguugauguacuuccacaggagagaccugagacuagcggcuaacgcuaucuguucagccgucccaguugauugggucccaaccagccgcacaaccuggucaauucaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguag

SEQ ID NO: 5490 - RNA, 9879 nt, Artificial Sequence
  derived and/or modified CDS sequence (wt) from DENV-1__KJ189368__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacuugggugaccuaugggacguguucucaaaacggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaaccuuggacauugaacucuugaagacggaggucacgaacccugccaucuugcgcaaacugugcauugaagccaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacaggguuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuagucacauuuaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcccauuuaagcuagagaaggaaguggcugagacucagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauacuccagaaugccccgauaaccaaagagcguggaacauuugggaaguugaggacuauggguuuggaauuuucacgacaaacaucugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguuguagauccugcacguuacccccccuacguuucagaggagaagacggauguugguauggcauggaaauuagaccaguaaaggagaaggaggagaaucuaguuaggucaauggucucugcagggucaggagaaguggacaguuuuucauuaggaauacuaugcguaucaauaaugauugaagaggugaugagaucuagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguuggguuauuauuucgcagacuaacauccagagaaguucuucuucucacgauuggauugagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccuuaaugaaggaauuauggcuauuggaauaguuagcauccuacuaaguucacuccuaaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccugaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggaaauaguugaccucaugugccacgccaccuuuaccaugcgucucuuauccccagugagaguucccaauuacaacaugaucaucauggacgaagcacauuuuaccgauccagccagcauagcggccagaggguacaucucaacccgagugggcaugggugaagcagcugcgaucuuuaugacagccacucccccaggaucaguggaggccuuuccacagagcaaugcaguuauccaagaugaggaaagagacauuccugagagaucauggaacucaggcuacgacuggaucacugauuuuccaggcaaaacagucugguuugucccaaguauuaaaucaggaaaugacauugcuaacuguuuaagaaagaacggaaaacggguaauucaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgcgucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucauuccagcccucuuugagccagagagagaaaagagugcagcaauagacggggaguacagacugcggggagaagcaaggaaaacguucguggagcucaugagaagaggagaucuaccaguuuggcuguccuacaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagcaucucaggugaccuaauauuggaaauagggaaacuuccacaacauuugacguuaagagcccagaaugcucuggacaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcagccuccaucauacuagaguucuuuuugauggugcugcuuauuccagagccagacagacagcgcacuccacaggacaaccagcuggcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuacucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucaccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaauuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggagccuaucccaauggcgaccuauggauggaaccuaguaaagcuacacucuggaaaagacguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaauaugauggggaagagagagaaaaaacuaggagaguuuggaaaggcaaaaggaagccgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaauucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaacuggaaacccccaaucuagcugagagaguuuuugacugguuagaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagcugucccaguugacugggucccaaccagccgcacaacuuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5491 - RNA, 9879 nt, Artificial Sequence
  derived and/or modified CDS sequence (wt) from DENV-1__KJ189369__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggugaacaccgacgagacaaacguuccguggcacuggccccacacgugggucuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauuuaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuugaaagggacgucauaugugaugugcacaggcucauuuaagcuagagaaggaaguggcugagacucagcauggaacuguucuagugcaggucaaauacgaaggaacagacgcgccauguaagauccccuuuucgacccaagaugagaaaggggugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaagggagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacauggcugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugcccugauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacgacagucacaggaaagauaauccaugaaugguguugcagauccugcacguuacccccauuacguuucagaggagaagacggauguugguauggcauggaaaucagaccaguaaaggagaaggaggagaaucuaguuaggucaauggucucugcagggucaggagaaguggacaguuuuucauuaggaauacuauguguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagcuaaugcuucagacaggauggggaugggaacaacguaccuagccuugauggcuacuuucaaaaugagaccaauguucgcuguuggguuauuauuucgcagacuaacauccagggaaguucuucuucucacgauuggauuaagcuugguggcaucuguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacauuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuccaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaagugggaccuacgucagugccauugcccaagcuaaggcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgcuucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucaucauggaugaagcacauuuuaccgauccagccagcauagcggccagaggguacaucucaacccgagugggcaugggugaagcagcugcgaucuucaugacagccacucccccaggaucgguggaggccuuuccacagagcaaugcagucauccaagaugaggaaagagacauuccugagagaucauggaacucaggcuacgauuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaacaaugaugaggaucacgcucacuggacagaagcaaaaaugcuccuugacaauauaaacacaccagaagggaucaucccagcccucuuugagccagagagagaaaagaaugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguucaaagaguuugcagcaggaagaagaagugucucaggugaccuaauauuggaaauagggaaacuuccacaacauuugacguuaagagcccagaaugcucuggacaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcgcuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacccuuugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaauuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuugaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaaguggcuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaauucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugaaaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagauuggcggcuaacgcuauuuguucagcugucccaguugacugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5492 - RNA, 9879 nt, Artificial Sequence
  derived and/or modified CDS sequence (wt) from DENV-1__EU482615__SS-prME
uccgugaccaugcuucucaugcuacugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacacagacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugcuauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccgccuuuuggugagagcuacaucgugguaggggcaggugaaaaagcuuuaaaacuaagcugguucaagaaaggaaguagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaagcagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccgggcaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugucacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaaugcuacugauacuuuguacaucacagauccucuugaugcggaccacaugggccuugugugaauccaucacacuggcuacuggaccccugaccacucucugggagggaucuccaggaaaauucuggaauacuacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgccaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuacaugacaucaaugaagagauucaagagugagagugaucccgaaggggcacucugguga

SEQ ID NO: 5493 - RNA, 9879 nt, Artificial Sequence
  derived and/or modified CDS sequence (wt) from DENV-1__EU482616__SS-prME
uccgugaccaugcuucucaugcugcugcccacagcccuggcguuccauuugaccacacgagggggagagccacacaugauaguuaauaagcaggaaagaggaaagucacucuuguuuaagaccuccgcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccauacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccaggucuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagacaccccagaaugccccgaugaccaaagagcguggaacauuugggaaguugaggacuauggguuuggaauuuucacgacaaacauaugguugaaauugcgugacuccuacacccaaaugugugaccaccggcuuaugucagcugccaucaaggacagcaaggcaguccaugcugacaugggguacuggauagagagugaaaagaacgaaaccuggaagcuggcgagagccuccuucauagaagucaagacaugcaccuggccgaaaucucacacucuauggagcaacggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgaggcccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguacuuagccuugauggcuacuuucaaaaugagaccaauguucgcuguugggcuauuauuucgcagacuaacauccagagaaguucuucuucucacgauuggauuaagcuugguggcauccguggaacuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagaaggaugacacacucacuauacuccuuaaagcaacuuugcuggcagucucaggaguguacccaaugucaauaccagcgacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaaaacuccugaaggugaaguuggagccauagcucuagauuuuaaacccggcacaucuggaucucccaucgugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucaugcucauuggacagaagcaaaaaugcuccuugacaauauaaacacaccagaagggaucaucccagcccucuuugagccagagagagaaaagagugcagcaauagacggagaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaacugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaacuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacugcuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaaaggauacacaaaaggaggaccuggacaugaggaaccuaucccaauggcgaccuauggauggaaccuaguaaagcuacacucuggaaaagauguauuuuuuaugccacccgagaaaugugacacccuucugugugauauuggugaguccucuccgaauccaacuauagaagaaggaagaacguuacguguuuuaaaaaugguggaaccauggcuaagaggaaaccaauuuugcauaaaaauccuaaauccuuacaugccaagugugguagaaacucuggagcaaaugcaaagaaaacauggagggaugcuagugcgaaacccacucucaagaaauuccacccaugaaauguacuggguaucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauucccauggucacacaaauagccaugaccgauaccacacccuuuggacaacagagaguguuuaaagagaaaguugacacgcgcacaccaagagcaaaacgaggcacaacacaaauuauggaggugacagccaagugguuaugggguuuccucuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcuaagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugauccugaaggggcacucugguga

SEQ ID NO: 5494 - RNA, 9879 nt, Artificial Sequence
  derived and/or modified CDS sequence (wt) from DENV-1__EU482618__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcugguguaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaauucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggauuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuugaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggaugggcuugcaauggguaucaugauguuaaaauuauugacugaauuucagccacaccaguuauggaccaccuuacugucccuaacauucaucaaaacaacucuuucauuggauuaugcauggaaaacaacggcuauggcacugucgaucguaucucucuuuccuuuaugccugucuacgaccucccaaaaaacaacauggcuuccggugcuguuaggaucuuuuggaugcaaaccguuaacuauguuucuuauaacagaaaauaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcagcugagguguccugggaacaagaggcagaacacuccgguaccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguuggguaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucgggcuacgacuggaucacugauuuuccagguaaaacagucugguuugucccaaguauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccucgacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuagaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucaugcugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagcugccgaaaaccaccaacaugcuacaaugcuggauguagaccuacguccagcuucagccuggacucuuuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagcuaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucacggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5495 - RNA, 9879 nt, Artificial Sequence
  derived and/or modified CDS sequence (wt) from DENV-1__EU482619__SS-prME
uccgugaccaugcuucucaugcugcugcccacagcccuggcguuccauuugaccacacgagggggagagccacacaugauaguuaguaagcaggaaagaggaaagucacucuuguucaagaccucugcaggugucaauaugugcacucucauugcgauggacuugggagaguuaugugaggacacaaugaccuacaaaugcccccagaucacugaggcggaaccagaugacguugacugcugguguaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacauuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguugguaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggauggacuugcaauggguaucaugauguuaaaauuauugacugaauuucagccacaccaguuauggaccaccuuacugucucuaacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaauaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacucugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggaguggggguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugaaagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuagaggagaacauggacguggagaucuggacaaaggaaggagaaagaaagaaauugcgaccccgcugguuggaugccagaacauacucagauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaaucuaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggagaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacucaugaaauguacuggguuucauguggaacaggaaacauugugucggcagugaacaugacauccagaauguuacugaaucgauucacaauggcucacaggaagccaacauacgaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucauugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccggaugggacacaagaguaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugagaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuauuuagauuauaugacaucaaugaagagauucaagaaugagagugaucccgaaggggcacucugguga

SEQ ID NO: 5496 - RNA, 9879 nt, Artificial Sequence
  derived and/or modified CDS sequence (wt) from DENV-1__FJ898433__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggagacuugggcuuugagacacccaggauucacggugacagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccucgaacagggcuggacuuuaaugaaauggugcuauugacaaugaaagaaaaaucauggcuuguccacaaacaaugguuucuggacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcgcugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccaguuaacauugagacagaaccaccuuuuggugagagcuacaucgugguaggagcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguauuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacucgugugaagguaccacagucguuguggaugaacauuguggaaaucgagguccuucucucagaaccacaacagucacaggaaagauaauccaugaaugguguugcagauccugcacguuaccucccuuacguuucagaggagaagacggauguugguauggcauggaaaucagaccaguaaaggagaaggaggagaaucuaguuaggucaauggucucugcagguucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaagaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggauggacuugcaauggguaucaugauguuaaaauuauugacugaauuccauccacaccaguuauggaccaccuuacugucucugacauucaucaaaacaacucuaucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaagcuggccccucaaugaaggaauuauggcuauuggaauaguuagcauucuacuaaguucacuccucaaaaaugaugugccguuggccggcccacuaauagcuggaggcaugcuaauagcauguuaugucauaucuggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuucacacaauguggcacgucaccaggggagcuguccuuauguaccaagggaagaggcuggaaccaagcugggccaguguaaaaaaagauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagagucgucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacagauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagcuggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguuuguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggagauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguuuuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggaggcaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaaaagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgacaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuauaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacacgcucuuuuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguugggaaaacauggugccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugaaagaaacugcuugccuaggcaagucauaugcacaaauguggcagcugauguacuuccacaggagagaccugagacuggcggcuaacgcuaucuguucagccgucccaguugauugggucccaaccagucgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagacuauaugacaucaaugaagagauucaagaaugagagugaucccgaaggggcacucugguga

SEQ ID NO: 5497 - RNA, 9879 nt, Artificial Sequence
  derived and/or modified CDS sequence (wt) from DENV-1__FJ547088__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacgcuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccagccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcuggggcaauggcuguggacuauucggaaagggaagccuauugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcugguuacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagacugauaacagccaaucccauagucacugacaaagaaaaaccagucaacauugagacugaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacauccgugggaaaauugguacaccagguuuuuggaaccgcauaugggguucuguucagcgguguuucuuggaccaugaaaauaggaauagggauucugcugacauggcugggauuaaauucaaggagcacgucacuuucgaugacgugcaucgcaguuggcaugguuacacuauaccuaggagucaugguucaagcggacucgggaugugugaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaauuauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuucuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuucccuuaugccugucuacgaccucccaaaaaacaacauggcuuccggugcuguuaggaucuuuuggaugcaaaccguuaaccauguuucuuauaacagaaaacaaaaucuggggaaggaaaaguuggccccucaaugaaggaaucauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucaccauacuccuuaaagcaacuuugcuggcagugucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugauuucauauggaggagguuggagguuucaaggaucauggaacacgggagaagaagugcaggugauagcuguugaaccaggaaaaaaccccaaaaauguacagacaacaccggguaccuucaagacuccugaaggugaaguuggagccauagcucuagauuuuaaacccggcacaucuggaucuccuaucgugaacagagagggaaaaauaguaggucuuuauggaaauggaguggugacaacaaguggaaccuacguuagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuucaugacagccacucccccaggaucgguggaggcuuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggauuauguugucacaacagacauuuccgaaaugggggcaaauuuccgggccgacaggguaauagacccaaggcggugcuugaaaccgguaauacuaaaagaugguccagagcgugucauucuagccggaccgaugccagugaccguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggacgccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggaaccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagcugccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugauacaaaauuugaaaaacagcuaggccaaauaauguuacugauacuuuguacaucacagauccucuuaaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaucuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuucaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaauauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggagugguaagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucgaacgcagcaauaggagcaguguucguugaugaaaaccaauggaacucagcaaaagaagcaguggaagacgaaagguuuugggaucucgugcacagagagagggagcuucauaaacagggaaaaugugccacgugcgucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggagggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggaugucauauccagacgugaccagagaggaaguggacaggucggaacuuauggcuuaaauacuuucacuaacauggagguccaacuaauaagacaaauggagucugaaggaaucuuuuuacccagcgaauuggaaacccccaaucuagcugggagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuagugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacccauguauccaguugggaagaaguuccauaccuagggaaaagggaagaucaaugguguggaucccugauaggcuugacagcgagggccaccugggccacuaacauacaaguggccauaaaccaagugagaagacucaucgggaaugagaauuaucuagauuauaugacaucaaugaagagauucaagaaugagagugaucccgaaggggcacucugguga

SEQ ID NO: 5498 - RNA, 9879 nt, Artificial Sequence
  derived and/or modified CDS sequence (wt) from DENV-1__FJ810419__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcugguguaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccagccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaauucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggauuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuugaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacgugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggccacuuucaaaaugagaccaauguucgcuguugggcuauuguuucgcagacuaacguccagagaaguucuucuucucacgauuggauuaagcuugguggcauccguggagcuaccaaauucuuuggaggagcuaggggaugggcuugcaauggguaucaugauguuaaaauuauugacugaauuucagccacaccaguuauggaccaccuuacugucucuaacauucaucaaaacaacucuuucauuggauuaugcauggaaaacaacggcuauggcacugucgaucguaucucucuuuccuuuaugccuguccacgaccucccaaaaaacaacauggcuuccggugcuguuaggaucuuuuggaugcaaaccguuaacuauguuucuuauaacagaaaauaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauauuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacgguguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaagacuucugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucgggcuacgacuggaucacugauuucccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugauugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccucgacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuagaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauaggcaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacuaggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugcgcugggcugaagaaagucacugaagugaagggauacacaaaaggaggaccuggacaugaggaaccuaucccaauggcgaccuauggauggaacuuaguaaagcuauacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaagacaauccauacaaaacaugggccuaucacggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuuuuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccugggcaagucauaugcacaaauguggcagcugauguacuuccauaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5499 - RNA, 9879 nt, Artificial Sequence
  derived and/or modified CDS sequence (wt) from DENV-1__FJ547068__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcugguguaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaauucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggauuuuaaugagauggugcuauugacaaugaaagaaaaaucauggcuuguccacaaacaaugguuuuuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcauacugcguugacuggggcgacagaaauccagacgucaggaacgacaacaaucuuugcaggacaucugaaaugcagacuaaaaauggauaaacugacuuugaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaagaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuuggcggcauccguggagcuaccaaauucuuuggaggagcuaggggaugggcuugcaauggguaucaugauguuaaaauuauugacugaauuucagccacaccaguuauggaccaccuuacugucucuaacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuucggaugcaaaccguuaacuauguuucuuauaacagaaaauaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguugugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaauacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucgggcuacgacuggaucacugauuuuccagguaaaacagucugguuugucccaaguauuaaaucaggaaaugacauugcuaacuguuugagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagauggcccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccucgacaauauaaacacaccagaagggaucaucccagcccucuuugagccagagagagaaaagagugcagcaauagacggggaguacagacuacggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuagaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaauauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccauuacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccaaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucacggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5500 - RNA, 9879 nt, Artificial Sequence
  derived and/or modified CDS sequence (wt) from DENV-1__FJ562104__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacgcuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccagccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcuggggcaaugguuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucgccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcugguuacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagacugauaacagccaaucccauagucacugacaaagaaaaaccagucaacauugagacugaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacauccgugggaaaauugguacaccagguuuuuggaaccgcauaugggguucuguucagcgguguuucuuggaccaugaaaauaggaauagggauucugcugacauggcugggauuaaauucaaggagcacgucacuuucgaugacgugcauugcaguuggcaugguuacacuauaccuaggagucaugguucaagcggacucgggaugugugaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaauuauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaaucauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugauuucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacguuagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuucaugacagccacucccccaggaucgguggaggcuuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugaccguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggacgccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggaaccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagcugccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugauacaaaauuugaaaaacagcuaggccaaauaauguuacugauacuuuguacaucacagauccucuuaaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaucuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuucaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaauauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucagcggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggaugucauauccagacgugaccagagaggaaguggacaggucggaacuuauggcuuaaauacuuucacuaacauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuagugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacccauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5501 - RNA, 9879 nt, Artificial Sequence
  derived and/or modified CDS sequence (wt) from DENV-1__GQ199857__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacgcuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccagccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcuggggcaauggcuguggacuauucggaaagggaagccuauugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcugguuacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagacugauaacagccaaucccauagucacugacaaagaaaaaccagucaacauugagacugaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacauccgugggaaaauugguacaccagguuuuuggaaccgcauaugggguucuguucagcgguguuucuuggaccaugaaaauaggaauagggauucugcugacauggcugggauuaaauucaaggagcacgucacuuucgaugacgugcaucgcaguuggcaugguuacacuauaccuaggagucaugguucaagcggacucgggaugugugaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaauuauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucauaucucucuuucccuuaugccugucuacgaccucccaaaaaacaacauggcuuccggugcuguuaggaucuuuuggaugcaaaccguuaaccauguuucuuauaacagaaaacaaaaucuggggaaggaaaaguuggccccucaaugaaggaaucauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucaccauacuccuuaaagcaacuuugcuggcagugucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugauuucauauggaggagguuggagguuucaaggaucauggaacacgggagaagaagugcaggugauagcuguugaaccaggaaaaaaccccaaaaauguacagacaacaccggguaccuucaagacuccugaaggugaaguuggagccauagcucuagauuuuaaacccggcacaucuggaucuccuaucgugaacagagagggaaaaauaguaggucuuuauggaaauggaguggugacaacaaguggaaccuacguuagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuucaugacagccacucccccaggaucgguggaggcuuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggauuauguugucacaacagacauuuccgaaaugggggcaaauuuccgggccgacaggguaauagacccaaggcggugcuugaaaccgguaauacuaaaagaugguccagagcgugucauucuagccggaccgaugccagugaccguggccagugcugcccagaggagaggaagaauuggaaggaaccaaaauaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggacgccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggaaccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagcugccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugauacaaaauuugaaaaacagcuaggccaaauaauguuacugauacuuuguacaucacagauccucuuaaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaucuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuucaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaauauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggagugguaagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucgaacgcagcaauaggagccguguucauugaugaaaaccaauggaacucagcaaaagaagcaguggaagacgaaagguuuugggaucucgugcacagagagagggagcuucauaaacagggaaaaugugccacgugcgucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggagggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggaugucauauccagacgugaccagagaggaaguggacaggucggaacuuauggcuuaaauacuuucacuaacauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuagugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguugucaguguggaauaggguuuggauagaggaaaacccauggauggaggacaaaacccauguauccaguugggaagaaguuccauaccuagggaaaagggaagaucaaugguguggaucccugauaggcuugacagcgagggccaccugggccacuaacauacaaguggccauaaaccaagugagaagacucaucgggaaugagaauuaucuagauuauaugacaucaaugaagagauucaagaaugagagugaucccgaaggggcacucugguga

SEQ ID NO: 5502 - RNA, 9879 nt, Artificial Sequence
  derived and/or modified CDS sequence (wt) from DENV-1__GQ199858__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacgcuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccagccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcuggggcaauggcuguggacuauucggaaagggaagccuauugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcugguuacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagacugauaacagccaaucccauagucacugacaaagaaaaaccagucaacauugagacugaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacauccgugggaaaauugguacaccagguuuuuggaaccgcauaugggguucuguucagcgguguuucuuggaccaugaaaauaggaauagggauucugcugacauggcugggauuaaauucaaggagcacgucacuuucgaugacgugcaucgcaguuggcaugguuacacuauaccuaggagucaugguucaagcggacucgggaugugugaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaauuauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucauaucucucuuucccuuaugccugucuacgaccucccaaaaaacaacauggcuuccggugcuguuaggaucuuuuggaugcaaaccguuaaccauguuucuuauaacagaaaacaaaaucuggggaaggaaaaguuggccccucaaugaaggaaucauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucaccauacuccuuaaagcaacuuugcuggcagugucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugauuucauauggaggagguuggagguuucaaggaucauggaacacgggagaagaagugcaggugauagcuguugaaccaggaaaaaaccccaaaaauguacagacaacaccggguaccuucaagacuccugaaggugaaguuggagccauagcucuagauuuuaaacccggcacaucuggaucuccuaucgugaacagagagggaaaaauaguaggucuuuauggaaauggaguggugacaacaaguggaaccuacguuagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuucaugacagccacucccccaggaucgguggaggcuuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggauuauguugucacaacagacauuuccgaaaugggggcaaauuuccgggccgacaggguaauagacccaaggcggugcuugaaaccgguaauacuaaaagaugguccagagcgugucauucuagccggaccgaugccagugaccguggccagugcugcccagaggagaggaagaauuggaaggaaccaaaauaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggacgccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggaaccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagcugccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugauacaaaauuugaaaaacagcuaggccaaauaauguuacugauacuuuguacaucacagauccucuuaaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaucuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggacuuggacaugaggaaccuaucccaauggcgaccuauggauggaaccuaguaaagcuacacucuggaaaagauguauuuuucaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaauauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggagugguaagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaaucauggaggugacagccaagugguuaugggguuuccuuuccagaaacaaaaaacccagaaucugcacaagagaggaguucacaagaaagguuaggucgaacgcagcaauaggagcaguguucguugaugaaaaccaauggaacucagcaaaagaagcaguggaagacgaaagguuuugggaucucgugcacagagagagggagcuucauaaacagggaaaaugugccacgugcgucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggagggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggaugucauauccagacgugaccagagaggaaguggacaggucggaacuuauggcuuaaauacuuucacuaacauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuagugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacccauguauccaguugggaagaaguuccauaccuagggaaaagggaagaucaaugguguggaucccugauaggcuugacagcgagggccaccugggccacuaacauacaaguggccauaaaccaagugagaagacucaucgggaaugagaauuaucuagauuauaugacaucaaugaagagauucaagaaugagagugaucccgaaggggcacucugguga

SEQ ID NO: 5503 - RNA, 9879 nt, Artificial Sequence
  derived and/or modified CDS sequence (wt) from DENV-1__GQ199859__SS-prME
uccgugaccaugcuccucaugcugcugcccacagcccuggcguuccauuugaccacacgggggggagagccacacaugauaguuaguaagcaugaaagaggaaagucacucuuguuuaagaccucuacaggugucaacaugugcacucucauugcgauggaccugggagaguuaugugaggacacaaugaccuacaaauguccccggauuacugaggcggaaccagaugacguugacugcuggugcaaugccacagacacaugggugaccuaugggacguguucucaaaccggcgaacaccgacgagauaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcuaaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaaccuuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacgcuuguggacagaggcugggguaaugguugcggacuauucggaaagggaagccuauugacgugugccaaguucaagugugugacaaaacuagaaggaaagauaguucaauaugaaaacuugaaauauucagugauagucacuguccacacuggggaccagcaccaggugggaaacgagacuacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacacuugaaaugcagacuaaaaauggauaaauugacuuuaaaggggacgucauaugugaugugcacaggcucauuuaagcuagagaaggaaguggcugagacccaacauggaacuguucuagugcaggucaaauacgaaggaacagacgcgccaugcaagauccccuuuucgacccaagaugagaaaggagugacccagaauggaagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaacugcccgaggagcacgaaggauggcuauccugggagacaccgcaugggacuucggcucuauaggaggaguguucacaucuguaggaaaauugguacaccagguuuuuggaaccgcauaugggguucuguucagcgguguuucuuggaccaugaaaauaggaauagggauucugcugacaugguugggauuaaauucaaggagcacgucacuuucaaugacgugcauugcaguuggcaugguuacacuguaccuaggagucaugguucaagcggacucgggauguguaaucaacuggaagggcagagaacuuaaauguggaaguggcauuuuugucacuaaugaaguccacacuuggacagagcaauacaaauuccaggcugauuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgaugaccaaagagcguggaacauuugggaaguugaggacuauggguuuggaauuuucacgacuaacauauggcugaaauugcgugacuccuacacccaaaugugugaccaccggcuaaugucagcugccaucaaggacagcaaggcaguccaugcugacaugggguacuggauagaaagugaaaagaacgaaaccuggaaguuggcgagagccuccuucauagaagucaagacaugcaccuggccgaaaucucacacucuauggagcaaugggguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucgauggucucugcagggucaggagaaguggacaguuuuucauugggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggauauuguuucgcagacuaacauccagagaaguucuucuucucacgauuggauuaagccugguggcauccguagagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuaugcauggaaaacaacggcuauggcacugucaaucgugucucucuuuccuuuaugccugucuacgaccucccaaaaaacaacauggcuuccggugcuguuaggaucuuuuggaugcaaaccauuaaccauguaucuuauaacagaaaacaaaaucuggggaaggaaaaguuggcccaucaaugaaggaauuauggcuauuggaauagucagcauucuacugaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacucagguaccucacacaacauauuaguagagguccaagaugauggaacuaugagaauaaaagaugaagagaaggaugacacacucacuauacuccuuaaagcaacuuugcuggcagucucaggaguguacccaaugucaauaccagcaacucuuuuugugugguauuucuggcagaaaaagaaacagagaucaggaguguuaugggacacacccagcccuccggaaguggaaagagcaguucuugaugauggcaucuauagaaucuugcaaagaggacuguugggcagaucccaagugggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaagucggagccauagcucuagauuuuaaacccggcacaucuggaucucccauugugaacagagagggaaaaauaguaggucuuuauggaaauggaguggugacaacaaguggaaccuacgucagugccauugcucaagcuaaagcaucacaggaagggccucuaccagagauugaggacgagguguucaagaaaagaaacuuaacaauaauggaccugcauccaggaucaggaaaaacaagaagauaucuuccggccauaguccgugaggccauaaaaaggaagcugcguacguuaaucuuggcucccacaagaguugucgccucugaaauggcagaggcgcucaagggaaugccaauaagauaucagacaacagcagugaagagugaacacacaggaagggagauaguagaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguagaggccuuuccacagaguaaugcaguuauccaagaugaggaaagagacauuccugagagaucauggaacucaggcuacgacuggaucacugauuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaacaaugauugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagccuuugaauaacgaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguauuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacacuugacgcugagagcccagaaugcucuggauaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuucuugauggugcugcucauuccagagccagacagacagcgcacuccacaggacaaccagcuagcauauguggugauagguuuguuauucaugauacugacaguggcagccaaugagaugggauuauuggaaaccacaaagagagaccuggggauuggccauguggccgccgaaaaccaccaacaugccacgaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggagucccacuucucgccuuggggugcuauucccaggugaacccauugacacugacagcggcaguguugauguuaguggcucauuaugccauaauuggaccaggacugcaagcaaaggccacuagagaagcucaaaaaaggacagcggccggaauaaugaaaaauccaacuguagacgggauuguugcuauagacuuggauccugugguuuaugaugcaaaauuugaaaaacagcuaggccaaauaaugcuacugauacuuuguacaucacaaauucucuugaugcggaccacaugggccuugugugaauccauuacacuggcgacuggaccccugaccacucucugggagggaucuccaggaaaauucuggaauaccacgauagcaguguccauggcaaacaucuucaggggaaguuaucuagcaggagcaggucuggcuuucucauugaugaaaucuuuaggaggagguaggagagguacgggagcucaaggggaaacacugggagagaaauggaaaagacaguuaaaccaacugagcaagccagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaagggaaagucauagaccucgguuguggaagggguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuuuugugugauauuggugaguccucuccgaauccaacuauagaagaaggaagaacgcuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaauauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuaugguaaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguugugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcauagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacaucaauuuuuaagcugaccuaucaaaauaagguggugagggugcaaagaccagcaaaaaauggaaccgugauggauguuauaucuagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuuguaggcagggcuagaguaucacaaggcgccggauggagccugagagaaacugcuugccuaggcaagucauaugcacaaauguggcaguugauguacuuccacaggagagaccugagacuagcggcuaacgcuaucuguucagccgucccaguugauugggucccaaccagccgcacaaccuggucaauucaugcccaccaccaauggaugacaacagaagacauguuaucaguguggaauaggguuuggauagaggaaaacccauggauggaggacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5504 - RNA, 9879 nt, Artificial Sequence
  derived and/or modified CDS sequence (wt) from DENV-1__JF937645__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcugguguaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacauccaggauucacggugauagcccuuuuuuuagcacaugccauaggaacauccaucacucagaaagggaucauuuucauuuugcugaugcuggugacaccaucaauggccaugcgaugcgugggaauaggcaacagagacuuuguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacgcuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacccagcauggaacuguucucgugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauuggugcaccagguuuuuggaaccgcguaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcucaaggaaaaaaaaugauuaggccacaacccauggaacacaaauacucauggaaaagcuggggaaaagcuaaaaucauaggagcagauauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccaaaaucucacacucuauggagcaacggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaaaauaauccaugaaugguguugcagauccugcacguuaccccccuuacguuucagaggagaagacggauguugguacggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacaauuggauuaagcuugguggcauccguggagcuaccaaauucuuuggaggagcuaggggauggacuugcaauggguaucaugauguuaaaauuauugacugaauuucagccacaccaguuauggaccaccuuacugucucuaacauucaucaaaacaacucuuucauuggauuaugcauggaaaacaacggcuauggcacugucaaucguaucucucuuuccuuuaugccuguccacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuaguauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggaucugaucucauauggaggagguuggagguuucaaggaucauggaacacgggggaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuucaugacagccacucccccaggaucgguggaggccuuuccacagagcaaugcaguuauccaagaugaggaaagagacauaccugagagaucauggaacucaggcuacgacuggaucacugauuuuccagguaaaacagucugguucgucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaccaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaucagguauuagaggagaacauggacguggagaucuggacaaaggaaggagaaaggaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggacccugugguuuaugaugcaaaauuugaaaaacagcuaggccaaauaauguuacugauacuuuguacaucacagauucucuugaugcggaccacaugggccuugugugaauccaucacacuggcuacuggaccccugaccacucucugggagggaucuccaggaaaauucuggaauaccacgauagcaguguccauggcaaacaucuucaggggaaguuauuuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacacgcagugucgagagggacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggaugucauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucuaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggccaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagugaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccacuugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5505 - RNA, 9879 nt, Artificial Sequence
  derived and/or modified CDS sequence (wt) from DENV-1__FJ850114__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcugguguaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacaucuaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugugucacuaccauggcaaaaaauaaaccaaccuuggacauugaacucuugaagacggaggucacgagcccugccaucuugcgcaaacugugcauugaagcuaaaauaucaaacaccaccaccgauucaagaugcccaacacaaggagaggcuacauugguggaagaacaagacgcgaacuuugugugucgccgaacauuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcaguauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacacgucuugagaacaucauguggaagcaaauaucaaaugaauugaaccacauucuacuugaaaaugacaugaaauucacagugguuguaggagaugcuaauggaauuuuggcccaagggaaaaagaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagacauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggccguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggaacuaccaaauucuuuggaggagcuaggggauggacuugcaauggguaucaugauguuaaaauuauugacugaauuucagccacaccaguuauggaccaccuuacugucucuaacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaauaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucagguuacgacuggaucacugauuuuccagguaaaacagucugguuugucccaaguauuaaaucaggaaaugacauugcuaacugccuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuagaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaauucuggagcaaaugcaaagaaaacauggagggaugcuagugcgaaacccacucucaagaaauuccacccaugaaauguacuggguuucauguggaacaggaaacauugugucggcagugaacaugacauccagaauguugcugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacgccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaucauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugauaucaaugaagagauucaagaaugagagcgaucccgaaggggcacucugguga

SEQ ID NO: 5506 - RNA, 9879 nt, Artificial Sequence
  derived and/or modified CDS sequence (wt) from DENV-1__JN819402__SS-prME
uccgugaccaugcuucucaugcuacugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacacagacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugcuauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacuaggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccgccuuuuggugagagcuacaucgugguaggggcaggugaaaaagcuuuaaaacuaagcugguucaagaaaggaaguagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaagcagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccgggcaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugucacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaaugcuacugauacuuuguacaucacagauccucuugaugcggaccacaugggccuugugugaauccaucacacuggcuacuggaccccugaccacucucugggagggaucuccaggaaaauucuggaauacuacgauagcaguguccaugacaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagacugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacuaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgccaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuacaugacaucaaugaagagauucaagagugagagugaucccgaaggggcacucugguga

SEQ ID NO: 5507 - RNA, 9879 nt, Artificial Sequence
  derived and/or modified CDS sequence (wt) from DENV-1__FJ850113__SS-prME
uccgugaccaugcuucucaugcuacugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacacagacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugcuauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggccacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggggugacccagaaugggagauugauaacagccaaucccauagucacugacaaagaaaaaccagucaacauugagacagaaccgccuuuuggugagagcuacaucgugguaggggcaggugaaaaagcuuuaaaacuaagcugguucaagaaaggaaguagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuaugguacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaagcagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccgggcaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugucacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaaugcuacugauacuuuguacaucacagauccucuugaugcggaccacaugggccuugugugaauccaucacacuggcuacuggaccccugaccacucucugggagggaucuccaggaaaauucuggaauacuacgauagcaguguccauggcaaacaucuucaggggaaguuaucuagcaggagcaggucuggcuuucucauuaaugaaaucuuuaggaggaggcaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacuaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgccaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuacaugacaucaaugaagagauucaagagugagagugaucccgaaggggcacucugguga

SEQ ID NO: 5508 - RNA, 9879 nt, Artificial Sequence
  derived and/or modified CDS sequence (wt) from DENV-1__JF937635__SS-prME
uccgugaccaugcuccucaugcugaugcccacagcccuggcguuccauuugaccacacgggggggagagccacacaugauaguuaguaagcaugaaagaggaaaggcacucuuguuuaagaccucuacaggugucaacaugugcacucucauugcgauggacuugggagaguuaugugaggacacaaugaccuacaaauguccccggauuacugaggcggaaccagaugauguugacugcuggugcaaugccacagacacaugggugaccuaugggacguguucacaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuucuuagcacaugccauaggaacauccaucacucagaaagggaucauuuucauuuugcuaaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaaccuuggacauugaacucuugaagacggaggucacgaacccugccgucuugcgcaaacugugcauugaagcuaaaauaucaaacaccaccaccgauucaagauguccaacacaaggagaggccacacugguggaagaacaagacgcgaacuuugugugucgccgaacguuuguggacagaggcugggguaaugguuguggacuauucggaaagggaagccuauugacgugugccaaguucaagugugugacaaaacuagaaggaaagauaguucaauaugaaaacuugaaauauucagugauagucacuguccacacuggggaccagcaccaggugggaaacgagacuacagaacauggaacaauugcaaccauaacaccucaagcuccuacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacacuugaaaugcagacuaaaaauggauaaacugacuuuaaaggggacgucauaugugaugugcacaggcucauuuaagcuagagaaggaaguggcugagacccaacauggaacuguucuagugcaggucaaauacgaaggaacagacgcgccaugcaagauccccuuuucgacccaagaugagaaaggagugacccagaauggaagauugauaacagccaaucccauaguuacugacaaagaaaaaccagucaacauugagacagaaccaccuuuuggugagagcuacaucgugguaggggcaggugaaaaagcucugaaacuaagcugguucaagaaaggaagcagcauagggaaaauguucgaagcaacugcccgaggagcacgaaggauggcuauccugggagacaccgcaugggacuucggcucuauaggaggaguguucacaucuguaggaaaauugguacaccagguuuuuggaacugcauaugggguucuguucagcgguguuucuuggaccaugaaaauaggaauagggauucugcugacaugguugggauuaaauucaaggagcacgucacuuucaaugacgugcauugcaguuggcaugguuacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuagaccacaacccauggaacacaaauacucauggaaaagcuggggaaaagcuaaaaucauaggagcagacauacaaaauaccaccuucaucaucgacggcccagauaccccagaaugccccgaugaccaaagagcguggaacauuugggaaguugaggacuauggguuuggaauuuucacgacuaacauauggcugaaauugcgugacuccuacacccaaaugugugaccaccggcuaaugucagcugccaucaaggacagcaaggcaguccaugcugacaugggguacuggauagaaagugaaaagaacgaaaccuggaaguuggcgagagccuccuucauagaagucaagacuugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucgauggucucugcagggucaggagaaguggacaguuuuucauugggaauacuaugcguaucaauaaugauugaagaagugaugagaucuagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggauauuguuucgcagacuaacauccagagaaguucuucuucucacgauuggauuaagccugguggcauccguagagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggcccaucaaugaaggaauuauggcuauuggaauagucagcauucuacugaguucacuccucaaaaaugaugugccguuggccggcccacuaauagcuggaggcaugcuaauagcauguuaugucauauccggaagcucagccgauuuaucauuggagaaagcggcugaggugucuugggaacaagaagcagaacacucagguaccucacacaacauauuaguagagguccaagaugauggaacuaugagaauaaaagaugaagagaaggaugacacacucacuauacuccuuaaagcaacuuugcuggcagucucaggaguguacccaaugucaauaccagcaacucuuuuugugugguauuucuggcagaaaaagaaacagagaucaggaguguuaugggacacacccagcccuccggaaguggaaagagcaguucuugaugauggcaucuauagaaucuugcaaagaggacuguuggguagaucccaagugggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuucugaaggcgaagucggagccauagcucuagauuuuaaacccggcacaucuggaucucccaucgugaacagagagggaaaaauaguaggucuuuauggaaauggaguggugacaacaaguggaaccuacgucagugccauugcucaagcuaaaacaucacaggaagggccuccaccagagauugaggacgagguguucaagaaaagaaacuuaacaauaauggaccugcauccaggaucaggaaaaacaagaagauaucuuccggccauaguccgugaggccauaaaaaggaagcugcguacguuaaucuuggcucccacaagaguugucgccucugaaauggcagaggcgcucaagggaaugccaauaagauaucagacaacagcagugaagagugaacacacaggaagggagauaguagaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguagaggccuuuccacagaguaaugcaguuauccaagaugaggaaagagacauuccugagagaucauggaacucaggcuacgacuggaucacugauuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaacaaugauugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagccuuugaauaacgaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguauuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacacuugacgcugagagcccagaaugcucuggauaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuucuugauggugcugcucauuccagagccagacagacaacgcacuccacaggacaaccagcuagcauauguggugauagguuuguuauucaugauacugacaguggcagccaaugagaugggauuauuggaaaccacaaagagagaccuggggauuggccauguggccgccgaaaaccaccaacaugccacaaugcuggacguagaccuacguccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggacauaggagucccacuucucgccuuagggugcuauucccaggugaacccauugacacugacagcggcaguguugauguuaguggcucauuaugccauaauuggaccaggacugcaagcaaaggccacuagagaagcucaaaaaaggacagcggccggaauaaugaaaaauccaacuguagacgggauuguugcuauagacuuggauccugugguuuaugaugcaaaauuugaaaaacagcuaggccaaauaaugcuacugauacuuuguacaucacaaauucucuugaugcggaccacaugggccuugugugaauccaucacacuggcgacuggaccccugaccacucucugggagggaucuccaggaaaauucuggaauaccacgauagcaguguccauggcaaacaucuucaggggaaguuaucuagcaggagcaggucuggcuuucucauugaugaaaucuuuaggaggagguaggagagguacgggagcucaaggggaaacacugggagagaaauggaaaagacaguuaaaccaacugagcaagccagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaagggaaagucauagaccucgguuguggaagggguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuuuugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuaguacgaaacccacucucaagaaauuccacccaugaaauguacuggguuucauguggaacaggaaauauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuaugguaaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaaaugguugugggguuuccucuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcauagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacaucaauuuuuaagcugaccuaucaaaauaagguggugagggugcaaagaccagcaaaaaauggaaccgugauggauguuauaucuagacgugaccagagaggaaguggacaggucggaacuuacggcuuaaauacuuucaccaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuuguaggcagggcuagaguaucacaaggcgccggauggagccugagagaaacugcuugccuaggcaagucauaugcacaaauguggcaguugauguacuuccacaggagagaccugagacuagcggcuaacgcuaucuguucagccgucccaguugauugggucccaaccagccgcacaaccuggucaauucaugcccaccaccaauggaugacaacagaagacauguuaucaguguggaauaggguuuggauagaggaaaacccauggauggaggacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5509 - RNA, 9879 nt, Artificial Sequence
  derived and/or modified CDS sequence (wt) from DENV-1__FJ024483__SS-prME
uccgugaccaugcuucucaugcugcugcccacagcccuggcguuccauuugaccacacgagggggagagccacacaugauaguuaguaagcaggaaagaggaaagucacucuuguuuaagaccucugcuggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuguugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugauaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacguguauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaauaccaaagauauauggaggaccaauaucucagcacaacuauagaccaggguauuacacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucccucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuugucauuggagaaagcggcugagguguccugggaacaagaggcagaacacuccgguaccucacacaacauacuaguagagguccaagaugauggaaccaugaaaauaaaagaugaagagagggaugacacacucacuauacuccuuaaagcuacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucacuaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccccuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaaggcuuccaguacuccgacagaagguggugcuuugauggggaaaggaacaaccagguguuggaggagaacauggacguggagaucuggacaaaggaaggagaaaggaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccacuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcugcuauauugaugggacuugacaagggauggccaauaucgaaaauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguugcguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacuuucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaggcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucauucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuagaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5510 - RNA, 9879 nt, Artificial Sequence
  derived and/or modified CDS sequence (wt) from DENV-1__EU596504__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcugguguaacgccacagacacaugggugaccuaugggacguguucucaaaccggcgaacaccgacgagacaaacguuccguggcucuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccagccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaauucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggauuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuugaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcuuugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagcccugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggaugggcuugcaauggguaucaugauguuaaaauuauugacugaauuucagccacaccaguuauggaccaccuuacugucucuaacauucaucaaaacaacucuuucauuggauuaugcauggaaaacaacggcuauggcacugucaaucguaucucucuuuccuuuaugccuguccacgaccucccaaaaaacaacauggcuuccggugcuguuaggaucuuuuggaugcaaaccguuaacuauguuucuuauaacagaaaauaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucgggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccucgacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuagaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacuaggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugcgcugggcugaagaaagucacugaagugaagggauacacaaaaggaggaccuggacaugaggaaccuaucccaauggcgaccuauggauggaaccuaguaaagcuauacucuggaaaagauguauuuuuuaugccaccugagaaaugugacacccuucugugugauauuggugaguccucuccgaauccaacuauagaagaaggaagaacguuacguauuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucacggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuuuuggaguucgaagcccuugguuucaugaaugaagaucacugguuuagcagagagaauucacucaguggaguggaaggagaaggacugcacaaacuuggauauauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugacugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5511 - RNA, 9879 nt, Artificial Sequence
  derived and/or modified CDS sequence (wt) from DENV-1__FJ024481__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcugguguaacgccacagacacaugggugaccuaugggacguguucucaaaccggcgaacaccgacgagacaaacguuccguggcucuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccagccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaauucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggauuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuugaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagcccugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggaugggcuugcaauggguaucaugauguuaaaauuauugacugaauuucagccacaccaguuauggaccaccuuacugucucuaacauucaucaaaacaacucuuucauuggauuaugcauggaaaacaacggcuauggcacugucaaucguaucucucuuuccuuuaugccuguccacgaccucccaaaaaacaacauggcuuccggugcuguuaggaucuuuuggaugcaaaccguuaacuauguuucuuauaacagaaaauaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucgggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccucgacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuagaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacuaggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugcgcugggcugaagaaagucacugaagugaagggauacacaaaaggaggaccuggacaugaggaaccuaucccaauggcgaccuauggauggaaccuaguaaagcuauacucuggaaaagauguauuuuuuaugccaccugagaaaugugacacccuucugugugauauuggugaguccucuccgaauccaacuauagaagaaggaagaacguuacguauuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucacggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuuuuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5512 - RNA, 9879 nt, Artificial Sequence
  derived and/or modified CDS sequence (wt) from DENV-1__GQ199872__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucaccaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagccgccaucaaggacagcaaggcaguccaugcugacaugggguacuggauagaaagugaaaagaacgaaaccuggaagcuggcgagagccuccuucauagaagucaagacaugcaccuggccgaaaucucacacucuauggaguaauggaguuuuggaaagugaaaugauaaucccaaagauauauggaggaccaauaucucagcacaacuauagaccaggguacuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagaucuagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccuaaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggggguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcaguaaagagugaacacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaagcauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagcuggaccaaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaagacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaaucuuaaauccuuacaugccaagugugguagaaacucuggagcaaaugcaaagaaaacauggagggaugcuagugcgaaacccgcucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagcuucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggccacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagaucauaugacaucaaugaagagauucaagaaugagagugaucccgaaggggcacucugguga

SEQ ID NO: 5513 - RNA, 9879 nt, Artificial Sequence
  derived and/or modified CDS sequence (wt) from DENV-1__FJ410290__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaacgccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgagcccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccucgaacagggcuggacuuuaaugagauggugcuauugacaaugaaagaaaaaucauggcuuguccacaaacaaugguuucuggacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggagcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguauuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaaccacaacagucacaggaaagauaauccaugaaugguguugcagauccugcacguuaccucccuuacguuucagaggagaagacggauguugguauggcauggaaaucagaccaguaaaggagaaggaggagaaucuaguuaggucaauggucucugcagggucaggagaaguggacaguuuuucauugggaauacuaugcguaucaauaaugauugaagaagugaugagauccagauggaguagaaagaugcugaugacuggaacacugguuguuuuccuccuucuuauaaugggacaacugacauggaaagaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaagaaaaagcuggccccucaaugaaggaauuauggcuauuggaauaguuagcauucuacuaaguucacuccucaaaaaugaugugccguuggccggcccacuaauagcuggaggcaugcuaauagcauguuaugucauaucuggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuucacacaauguggcacgucaccaggggagcuguccuuauguaccaagggaagaggcuggaaccaagcugggccaguguaaaaaaggauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggagauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguuuuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauucgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggaggcaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguagcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugaaauugcucacaaaaccaugggauguuauccccauggucacacaaauagcuaugaccgacaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuauaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguugggaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcgacuaaugcuaaauguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaggagauucaagaaugagagugaucccgaaggggcacucugguga

SEQ ID NO: 5514 - RNA, 9879 nt, Artificial Sequence
  derived and/or modified CDS sequence (wt) from DENV-1__FJ024423__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugguagccuuuuuuuuagcacaugccauaggaacauccaucacucagaaagggaucauuuucauuuugcugaugcuggugacaccaucaauggccaugcgaugcgugggaauaggcaacagagacuuuguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauuuggaaagggaagccuauugacgugugccaaguucaagugugugacaaaacuagaaggaaagauaguucaauaugaaaacuuaaaauauucagugauagucacuguccacacuggggaccagcaccaggugggaaaugagacuacagaacauggaacaauugcgaucauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauucaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugauaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccaggucuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagacaccccagaaugccccgaugaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguacuuagccuugauggcuacuuucaaaaugagaccaauguucgcuguugggcuauuauuccgcagacuaacauccagagaaguucuucuucucacgauuggauuaagcuugguggcauccguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauaucuggaagcucagccgauuuaucauuggagaaagcggcugagguguccugggaacaagaggcagaacacuccgguaccucacacaacauacuaguagagguccaagaugauggaacuaugaaaauaaaagaugaagagaaggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaaaacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucaugcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaacugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaacuccgaacaaggaggaaaagccuauagacaugccauggaggaauuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaaaggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggauccccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaaaggauacacaaaaggaggaccuggacaugaggaaccuaucccaauggcgaccuauggauggaaccuaguaaagcuacacucuggaaaagauguauuuuuuaugccacccgagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcuaagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugauccugaaggggcacucugguga

SEQ ID NO: 5515 - RNA, 9879 nt, Artificial Sequence
  derived and/or modified CDS sequence (wt) from DENV-1__FJ547089__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcugguguaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacauuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguugguaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagacaauccaugaaugguguugcagauccugcacguuaccccccuuacgcuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggauggacuugcaauggguaucaugauguuaaaauuauugacugaauuucagccacaccaguuauggaccaccuuacugucucuaacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaauaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacucugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggaguggggguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuagaggagaacauggacguggagaucuggacaaaggaaggagaaagaaagaaauugcgaccccgcugguuggaugccagaacauacucagauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaaucuaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggagaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggagugccugcacgugaggaaccuauccccauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacucaugaaauguacuggguuucauguggaacaggaaacauugugucggcagugaacaugacauccagaauguuacugaaucgauucacaauggcucacaggaagccaacauacgaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucauugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccggaugggacacaagaguaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugagaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5516 - RNA, 9879 nt, Artificial Sequence
  derived and/or modified CDS sequence (wt) from DENV-1__FJ024484__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugguagccuuuuuuuuagcacaugccauaggaacauccaucacucagaaagggaucauuuucauuuugcugaugcuggugacaccaucaauggccaugcgaugcgugggaauaggcaacagagacuuuguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauuuggaaagggaagccuauugacgugugccaaguucaagugugugacaaaacuagaaggaaagauaguucaauaugaaaacuuaaaauauucagugauagucacuguccacacuggggaccagcaccaggugggaaaugagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauucaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugauaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccaggucuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagacaccccagaaugccccgaugaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguacuuagccuugauggcuacuuucaaaaugagaccaauguucgcuguugggcuauuauuccgcagacuaacauccagagaaguucuucuucucacgauuggauuaagcuugguggcauccguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauaucuggaagcucagccgauuuaucauuggagaaagcggcugagguguccugggaacaagaggcagaacacuccgguaccucacacaacauacuaguagagguccaagaugauggaacuaugaaaauaaaagaugaagagaaggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaaaacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgccaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucaugcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaacugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaacuccgaacaaggaggaaaagccuauagacaugccauggaggaauuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuucuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaaaggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugaccaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaaaggauacacaaaaggaggaccuggacaugaggaaccuaucccaauggcgaccuauggauggaaccuaguaaagcuacacucuggaaaagauggauuuuuuaugccacccgagaaauguggcacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagaucccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcuaagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugauccugaaggggcacucugguga

SEQ ID NO: 5517 - RNA, 9879 nt, Artificial Sequence
  derived and/or modified CDS sequence (wt) from DENV-1__EU596503__SS-prME
uccgugaccaugcuucucaugcugcugcccacagcccuggcauuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcugguguaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaauuuaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggauuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuugaaagggacgucauaugugaugugcauaggcucauuuaagcuagagaaggaaguggcugagacccagcauggaacuguuuuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaauguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacaguuacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaacgggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggaugggcuugcaauggguaucaugauguuaaaauuauugacugaauuucagccacaccaguuauggaccaccuuacugucucuaacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaauaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauauuaguagagguccaagaugauggaacuaugaaaauaaaagaugaagagagggacgacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaaggaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucgggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccucgacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuagaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacagggaggaaaagccuauagacaugccauggaggaacuaccagacaccauagaaacauugaugcuucuagcuuugauagcugugcugacugguggagugacgcuguucuuccuaucaggaaaaggucuagggaaaacauccaucggccugcucugugugacggccucaagcgcacuguuguggauggccaguguggagccccauuggauagcagccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggauugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggccaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucacggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccaguugaucaugaaggaugggagggaaauaguggugccaugccgcaaccaagaugaacuugugggcagggcuagaguaucacaaggcgcuggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5518 - RNA, 9879 nt, Artificial Sequence
  derived and/or modified CDS sequence (wt) from DENV-1__FJ024479__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuauaaaugcccccagaucacugaggcggaaccagaugacguugacugcugguguaacgccacagacacaugggugaccuaugggacguguucucaaaccggcgaacaccgacgagacaaacguuccguggcacuagccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguuugaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacaccuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacgguccagauaccccagaaugccccgauaaccaaagagcguggaacauuugggaaguugaggacuauggguuuggauuuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaccuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggaugggcuugcaauggguaucaugauguuaaaauuauugacugaauuucagccacaccaguuauggaccaccuuacugucucuaacauucaucaaaacaacucuuucauuggauuaugcauggaaaacagcggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaauaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaauauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucgggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgccaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugauaauauaaccacaccagaagggaucaucccagcccucuuugagccagagagagaaaagagugcagcaauagacggggaguccagacugcggggagaaccaaggaaaacguucguggagcucaugagaagaggagaucuaccaguuuggcuguccuauaaaguagccucagaagguuuccaguacuccgacagaagguggugcuuugauggggaaaggaacaaccagguguuagaggagaacauggacguggagaucuggccaaaggaaggagaaagaaagaaauugcgaccccgcugguuggaugccagaacauacucugauccauuggcccugggcgaguuuaaagaguuuggagcaggaagaagaaguggcucaggugcccuaauauuggaaauagggaaacuuccacaacauuugccgcuaagagcccagaauggucuggauaacuuggucauggugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacucuuguggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugccaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuggacaucacagauccucuugaugcggaccacaugggccuugggugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagcuaaacugaggugguuuguggagaggaaccucgugaacccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuauccccccugagaaaugugacacccuucugugugauauuggugaguccucuccgaauccaacuauagaagaaggaagaacguuacgugguuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauggacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguggucguugaugaaaaccaauggaacucagcaaaagaagcaggggaagacgaaaggguuugggaucucggggacagagagagggagcuucauaaacagggaaaaugugccacguguggcuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacuuagagacauaucaaagauuccggggggaaauauguaugcagaugauacagccgggugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugcccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaaguggcuuucuggucacaccauuuccaccagcugaucaugaaggaugggagggaaauaguggugccaugccgcaaccaagaugaacuugggggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5519 - RNA, 9879 nt, Artificial Sequence
  derived and/or modified CDS sequence (wt) from DENV-1__FJ182002__SS-prME
uccgugaccaugcuucucaugcugcugcccacagcccuggcauuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcugguguaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaauucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggauuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuugaaagggacgucauaugugaugugcacaggcucauuuaagcuagagaaggaaguggcugagacccagcauggaacuguuuuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacaguuacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaacgggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggaugggcuugcaauggguaucaugauguuaaaauuauugacugaauuucagccacaccaguuauggaccaccuuacugucucuaacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaauaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucgggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggacccaaaccaaggaaggugaucaguauguuuacaugggacagccuuuaaauaaugaugaggaucacgcucauuggacagaagcaaaaaugcuccucgccaauauaaacacaccagaagggaucaucccagcccucuuugagccagagagagaaaagaguccagcaauagacggggaguacagacugcggggagaagcaaggaaaacguucguggagcucaugagaagaggagaucuaccaguuuggcuguccuauaaaguagccucagaagguuuccaguacuccgacagaagguggugguuugauggggaaaggaacaaccagguguuagaggagaacauggacguggagaucuggacaaaggaaggagaaagaaagaaauugcgaccccgcugguuggaugccagaacauacucugauccauuggcccugggcgaguuuaaagaguuuggagcaggaagaagaaguggcucaggugaccuaauauuggaaauagggaaacuuccacaacauuugacgcuaagagcccagaauggucuggauaacuuggucauggugcacaauuccgaacaaggaggaaaagccuauagacaugccauggaggaacuaccagacaccauagaaacauugaugcuucuagcuuugauagcugugcugacugguggagugacgcuguucuuccuaucaggaaaaggucuagggaaaacauccaucggccugcucugugugacggccucaagcgcacuguuguggauggccaguguggagccccauuggauagcagccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggauugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucacggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaggggaagacgaaaggguuugggaucucguggacagagagagggagcuucauaaacagggaaaauggggcacggggggcuacaacaugauggggaagagagagaaaaaacuaggagaguuuggaaaggcaaaaggaagucguggaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgggugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaaugccaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuggucacaccauuuccaccaguugaucaugaaggaugggagggaaauaguggugccaugccgcaaccaagaugaacuugugggcagggcuagaguaucacaaggcgcuggauggagccugagagaaacugcuuggcuaggcaagucauaugcacaaauggggcagcugauguacuuccacaggagagaccugagacuggcggcuaacgcuaucuggucagccggcccaggugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5520 - RNA, 9879 nt, Artificial Sequence
  derived and/or modified CDS sequence (wt) from DENV-1__FJ024482__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacgcuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuuugacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggauuacgguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacucaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaggagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggccaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauggugcacaauuccgaacaaggaggaaaagccuauagacaugccauggaggaacuaccagacaccauagaaacauugaugcuucuagcuuugauagcuguguugacugguggagugacgcuguucuuccuaucaggaaaagguuuagggaaaacauccaucggccugcucugugugacggccucaagcgcacuguuguggauggccaguguggagccucauuggauagcggccuccaucauacuagaguucuuuuugauggugcugcuuauuccagagccagacagacagcgcacuccacaggacaaccagcuagcauauguggugauagguuuguuauucuugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugauacaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcuggacugaagaaagucacugaagugaagggauauacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccauacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggaugucauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucauucaguggaguggaaggagaaggacugcacaaacuuggauacauacucagagacauaucaaagauuccggggggaaauauguaugcagaugauacagccgggugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaacugugauggauguuauauccagacgugcccagagaggaaguggccaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagcuuuaacagcccugaaugccaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5521 - RNA, 9879 nt, Artificial Sequence
  derived and/or modified CDS sequence (wt) from DENV-1__EU596501__SS-prME
uccgugaccaugcuucucaugcugcugcccacagcccuggcguuccauuugacaacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguuccguggcauuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacccagaaagggaucauuuucauuuugcugaugcuggugacaccaucaauggccaugcgaugcgugggaauaggcaacagagacuucguugaaggacugucaggagcaacguggguggacgugguauuggagcauggaagcugugucacuaccauggcaaaaaauaaaccaaccuuggacauugaacucuugaagacggaggucacgaacccugccaucuugcgcaaacuguguauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguuaaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucuccuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaaucauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacuuacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucaugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccgggcaccuucaagacucuugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuacuaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccugucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagacuuacguccagcuucagccuggacucucuacgcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagagggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccucccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagcuucaucuauggugaauggaguggugagauugcucacaaaaccaugggauguuauccccauggucacacaaauagcuaugaccgauaccacacccuuuggacaacagagaguguucaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacguguguuuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcccuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaacgacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuacaugacaucaaugaagagauucaagaaugagagugaucccgaaggggcacucugguga

SEQ ID NO: 5522 - RNA, 9879 nt, Artificial Sequence
  derived and/or modified CDS sequence (wt) from DENV-1__FJ898437__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcugguguaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguugguaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcaaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacagggaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggauggacuugcaauggguaucaugauguuaaaauuauugacugaauuucagccacaccaguuauggaccaccuuacugucucuaacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaauaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuagaggagaacauggacguggagaucuggacaaaggaaggagaaagaaagaaauugcgaccccgcugguuggaugccagaacauacucagauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacauguuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaaucuaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauacgaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucauugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccggaugggacacaagaguaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugagaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagagaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5523 - RNA, 9879 nt, Artificial Sequence
  derived and/or modified CDS sequence (wt) from DENV-1__FJ024480__SS-prME
uccgugaccaugcuucucaugcugcugcccacagcccuggcauuccauuugaccacacgagggggagagccacacaugauaguuaguaagcaggaaagaggaaaaucacucuuguuuaagaccucugcaggugucaauaugugcacucucauugcgauggacuugggagaguuaugugaggacacaaugaccuacaaaugcccccagaucacugaggcggaaccagaugacguugacugcugguguaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagccuauugacgugugccaaauucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggauuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuugaaagggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccagguuuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuucucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugauggcauccguggagcuaccaaauucuuuggaggagcuaggggaugggcuugcaauggguaucaugauguuaaaauuauugacugaauuucagccacaccaguuauggaccaccuuacugucucuaacauucaucaaaacaacucuuucauuggauuaugcauggaaaacaacggcuauggcacugucaaucgugucucucuuuccuuuaugccugucuacgaccucccaaaaaacaacauggcuuccggugcuguuaggaucuuuuggaugcaaaccguuaacuauguuucuuauaacagaaaauaaaaucuggggaaggaaaaguuggccccucaaugaaggaauuauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucgggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccucgacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuagaggagaacauggacguggagaucuggacaaaggaaggagaaagaaagaaauugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcagccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggauugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucacggaucauaugaggucaagccaucaggaucagccucaucuauggugaauggaguggugaaauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuccagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccaguugaucaugaaggaugggagggaaauaguggugccaugccgcaaccaagaugaacuugugggcagggcuagaguaucacaaggcgcuggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5524 - RNA, 9879 nt, Artificial Sequence
  derived and/or modified CDS sequence (wt) from DENV-1__FJ873814__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugguagccuuuuuuuuagcacaugccauaggaacauccaucacucagaaagggaucauuuucauuuugcugaugcuggugacaccaucaauggccaugcgaugcgugggaauaggcaacagagacuuuguugaaggacugucaggagcaacguggguggacgugguauuggagcauggaagcugcgucacuaccauggcaaaaaauaaaccaaccuuggacauugaacucuugaagacggaggucacgaacccugccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauuuggaaagggaagccuauugacgugugccaaguucaagugugugacaaaacuagaaggaaagauaguucaauaugaaaacuuaaaauauucagugauagucacuguccacacuggggaccagcaccaggugggaaaugagacuacagaacauggaacaauugcgaucauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaagggacgucauaugugaugugcacaggcucauucaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugauaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacaucugugggaaaauugguacaccaggucuuuggaaccgcauaugggguucuguucagcgguguuucuuggacuaugaaaauaggaauagggauucugcugacaugguugggauuaaauucaaggagcacgucacuuucgaugacgugcauugcaguuggcaugguuacacuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagacaccccagaaugccccgaugaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguacuuagccuugauggcuacuuucaaaaugagaccaauguucgcuguugggcuauuauuccgcagacuaacauccagagaaguucuucuucucacgauuggauuaagcuugguggcauccguggagcuaccaaauucuuuggaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaauuauggcuauuggaauaguuagcauccuacuaaguucacuccucaaaaaugaugugccguuggccggcccacuaauagcuggaggcaugcuaauagcauguuaugucauaucuggaagcucagccgauuuaucauuggagaaagcggcugagguguccugggaacaagaggcagaacacuccgguaccucacacaacauacuaguagagguccaagaugauggaacuaugaaaauaaaagaugaagagaaggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugaucucauauggaggagguuggagguuucaaggaucauggaacacgggagaagaagugcaggugauagcuguugaaccaggaaaaaaccccaaaaauguacagacaacgccggguaccuucaaaacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucaugcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaacugcgaccccgcugguuggaugccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaacuccgaacaaggaggaaaagccuauagacaugccauggaggaauuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaaaggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggauccccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaaaggauacacaaaaggaggaccuggacaugaggaaucuaucccaauggcgaccuaugcauggaaccuaguaaagcuacacucuggaaaagauguauuuuuuaugccacccgagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcuaagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugauccugaaggggcacucugguga

SEQ ID NO: 5525 - RNA, 9879 nt, Artificial Sequence
  derived and/or modified CDS sequence (wt) from DENV-1__JN819403__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacgcuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacacgccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccagccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcuggggcaauggcuguggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcugguuacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagacugauaacagccaaucccauagucacugacaaagaaaaaccagucaacauugagacugaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacauccgugggaaaauugguacaccagguuuuuggaaccgcauaugggguucuguucagcgguguuucuuggaccaugaaaauaggaauagggauucugcugacauggcugggauuaaauucaaggagcacgucacuuucgaugacgugcauugcaguuggcaugguuacacuauaccuaggagucaugguucaagcggacucgggaugugugaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaauuauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccguuaacuauguuucuuauaacagaaaacaaaaucuggggaaggaaaaguuggccccucaaugaaggaaucauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugauuucauauggaggagguuggagguuucaaggaucauggaacacgggagaagaagugcaggugauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacguuagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuucaugacagccacucccccaggaucgguggaggcuuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugaccguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggacgccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggaaccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagcugccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugauacaaaauuugaaaaacagcuaggccaaauaauguuacugauacuuuguacaucacagauccucuuaaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugagggaccuaucccaauggcgaccuauggauggaaccuaguaaagcuacacucuggaaaagauguauuuuucaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaauauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggaugucauauccagacgugaccagagaggaaguggacaggucggaacuuauggcuuaaauacuuucacuaacauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuagugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacccauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuauaugacaucaaugaagagauucaagaaugagagugaucccgaaggggcacucugguga

SEQ ID NO: 5526 - RNA, 9879 nt, Artificial Sequence
  derived and/or modified CDS sequence (wt) from DENV-1__KF973453__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacgcuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacuaacccagccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcuggggcaauggcuguggacuauucggaaagggaagccuauugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcugguuacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagacugauaacagccaaucccauagucacugacaaagaaaaaccagucaacauugagacugaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacauccgugggaaaauugguacaccagguuuuuggaaccgcauaugggguucuguucagcgguguuucuuggaccaugaaaauaggaauagggauucugcugacauggcugggauuaaauucaaggagcacgucacuuucgaugacgugcaucgcaguuggcaugguuacacuauaccuaggagucaugguucaagcggacucgggaugugugaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaauuauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuaggcuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucauaucucucuuucccuuaugccuguccacgaccucccaaaaaacaacauggcuuccggugcuguuaggaucuuuuggaugcaaaccguuaaccauguuucuuauaacagaaaacaaaaucuggggaaggaaaaguuggccccuuaaugaaggaaucauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucaccauacuccuuaaagcaacuuugcuggcagugucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugauuucauauggaggagguuggagguuucaaggaucauggaacacgggagaagaagugcaggugauagcuguugaaccaggaaaaaaccccaaaaauguacagacaacaccggguaccuucaagacuccugaaggugaaguuggagccauagcucuagauuuuaaacccggcacaucuggaucuccuaucgugaauagagagggaaaaauaguaggucuuuauggaaauggaguggugacaacaaguggaaccuacguuagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaacuacaacaugauuauuauggaugaagcacauuuuaccgauccagccagcauagcggccagaggguacaucucaacccgaguggguaugggugaagcagcugcgaucuucaugacagccacucccccaggaucgguggaggcuuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggauuauguugucacaacagacauuuccgaaaugggggcaaauuuccgggccgacaggguaauagacccaaggcggugcuugaaaccgguaauacuaaaagaugguccagagcgugucauucuagccggaccgaugccagugaccguggccagugcugcccagaggagaggaagaauuggaaggaaccaaaauaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaagaaacaaccagguguuggaggagaacauggacguggagaucuggacaaaggaaggagaaagaaagaaacugcgaccccgcugguuggacgccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggaaccccauuggauagcggccuccaucauacuagaguucuuucugauggugcugcuuauuccagagccagacagacagcgcacuccacaggauaaccagcuagcauauguggugauagguuuguuauucaugauacugacaguggcagccaaugagaugggguuauuggaaaccacaaagaaagaccuggggauuggccauguagcugccgaaaaccaucaacaugcuacaaugcuggacguagaccuacguccagcuucagccuggacucucuaugcaguggccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugauacaaaauuugaaaaacagcuaggccaaauaauguuacugauacuuuguacaucacagauccucuuaaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaucuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuucaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaauauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggagugguaagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucgaacgcagcaauaggagcaguguucguugaugaaaaccaauggaacucagcaaaagaagcaguggaagacgaaagguuuugggaucucgugcacagagagagggagcuucauaaacagggaaaaugugccacgugcgucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggagggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggaaccugaacaugcucuauuggcuacgucaauuuuuaagcugacuuaucaaaacaaaguggugagggugcaaagaccagcaaaaaacggaaccgugauggaugucauauccagacgugaccagagaggaaguggacaggucggaacuuauggcuuaaauacuuucacuaacauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuagugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacccauguauccaguugggaagaaguuccauaccuagggaaaagggaagaucaaugguguggaucccugauaggcuugacagcgagggccaccugggccacuaacauacaaguggccauaaaccaagugagaagacucaucgggaaugagaauuaucuagauuauaugacaucaaugaagagauucaagaaugagagugaucccgaaggggcacucugguga

SEQ ID NO: 5527 - RNA, 9879 nt, Artificial Sequence
  derived and/or modified CDS sequence (wt) from DENV-1__KF973454__SS-prME
uccgugaccaugcuccucaugcugcugcccacagcccuggcguuccauuugaccacacgggggggagagccacacaugauaguuaguaagcaugaaagaggaaagucacucuuguuuaagaccucuacaggugucaacaugugcacucucauugcgauggaccugggagaguuaugugaggacacaaugaccuacaaauguccccggauuacugaggcggaaccagaugacguugacugcuggugcaaugccacagacacaugggugaccuaugggacguguucucaaaccggcgaacaccgacgagauaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccauuacucagaaagggaucauuuucauuuugcuaaugcuggugacaccaucaauggccaugcgaugcgugggaauaggcaacagagacuucguugaaggacugucaggagcaacguggguggaugugguauuggagcauggaagcugcgucaccaccauggcaaaaaauaaaccaaccuuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacgcuuguggacagaggcugggguaaugguugcggacuauucggaaagggaagccuauugacgugugccaaguucaagugugugacaaaacuagaaggaaagauaguucaauaugaaaacuugaaauauucagugauagucacuguccacacuggggaccagcaccagguaggaaacgagacuacagaacauggaacaauugcaaccauaacaccucaagcucccacgucggaaauacagcugacugacuacggagcccucgcauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguaguaguacugggaucacaggaaggagcaaugcacacugcguugacuggggcgacagaaauccagacgucaggaacgacaacaauuuuugcaggacacuugaaaugcagacuaaaaauggauaaauugacuuuaaaggggacaucauaugugaugugcacaggcucauuuaagcuagagaaggaaguggcugagacccaacauggaacuguucuagugcaggucaaauacgaaggaacagacgcgccaugcaagauccccuuuucgacccaagaugagaaaggagugacccagaauggaagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaacugcccgaggagcacgaaggauggcuauccugggagacaccgcaugggacuucggcucuauaggaggaguguucacaucuguaggaaaauugguacaccagguuuuuggaaccgcauaugggguucuguucagcgguguuucuuggaccaugaaaauaggaauagggauucugcugacaugguugggauuaaauucaaggagcacgucacuuucaaugacgugcauugcaguuggcaugguuacacuguaccuaggagucaugguucaagcggacucgggauguguaaucaacuggaagggcagagaacuuaaauguggaaguggcauuuuugucacuaaugaaguccacacuuggacagagcaauacaaauuccaggcugauuccccaaaaagacugucagcagccauuggaaaggcaugggaggagggcguguguggaauucgaucagccacgcgucuugagaacaucauguggaagcaaauaucaaaugaauugaaccacauucuacucgaaaaugacaugaaauucacagugguuguaggagaugcuaauggaauuuuggcccaagggaaaaaaaugauuaggccacaacccauggaacacaaauacucauggaaaaguuggggaaaagcuaaaaucauaggagcagacauacaaaauaccaccuucaucaucgacggcccagauaccccagaaugccccgaugaccaaagagcguggaacauuugggaaguugaggacuauggguuuggaauuuuuacgacuaacauauggcuaaaauugcgugacuccuacacccaaaugugugaccaccggcuaaugucagcugccaucaaggacagcaaggcaguccaugcugacaugggguacuggauagaaagugaaaagaacgaaaccuggaaguuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucgauggucucugcagggucaggagaaguggacaguuuuucauugggaauacuaugcguaucaauaaugauugaagaagugaugagauccagauggaguagaaagaugcugaugacuggaacacuggcuguuuuccuccuucuuauaaugggacaacugacauggaaugauuugauuagguuaugcaucaugguuggagcuaaugcuucagacaggauggggaugggaacaacguaccuagccuugauggcuacuuucaaauugagaccaauguucgcuguugggauauuguuucgcagacuaacauccagagaaguucuucuucucacgauuggauuaagccugguggcauccguagagcuaccaaauucuuuggaggagcuaggggauggacuugcaauggguaucaugauguuaaaauuauugacugaauuucagccacaccaguuauggaccacuuuacugucucugacauuuaucaaaacaacucuuucacuggauuaugcauggaaaacaacggcuauggcacugucaaucgugucucucuuuccuauaugccugucuacgaccucccaaaaaacaacauggcuuccggugcuguuaggaucuuuuggaugcaaaccauuaaccauguaucuuauaacagaaaacaaaaucuggggaaggaaaaguuggcccaucaaugaaggaauuauggcuauuggaauagucagcauucuacugaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacucagguaccucacacaacauauuaguagagguccaagaugauggaacuaugagaauaaaagaugaagagaaggaugacacacucacuauacuccuuaaagcaacuuugcuagcagucucaggaguguacccaaugucaauaccagcaacucuuuuugugugguauuucuggcagaaaaagaaacagagaucaggaguguuaugggacacacccagcccuccggaaguggaaagagcaguucuugaugauggcaucuauagaaucuugcaaagaggacuguugggcagaucccaagugggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaagucggagccauagcucuagauuuuaaacccggcacaucuggaucucccauugugaacagagagggaaaaauaguaggucuuuauggaaauggaguggugacaacaaguggaaccuacgucagugccauugcucaagcuaaagcaucacaggaagggccucuaccagagauugaggacgagguguucaagaaaagaaacuuaacaauaauggaccugcauccaggaucagggaaaacaagaagauaucuuccggccauaguccgugaggccauaaaaaggaagcugcguacguuaaucuuggcucccacaagaguugucgccucugaaauggcagaggcgcucaagggaaugccaauaagauaucagacaacagcagugaagagugaacacacaggaagggagauaguagaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguagaggccuuuccacagaguaaugcaguuauccaagaugaggaaagagacauuccugagagaucauggaacucaggcuaugacuggaucacugauuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaacaaugauugggacuauguugucacaacagacauuuccgaaaugggggcaaauuuccgggccgacaggguaauagacccaaggcgaugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagccuuugaauaacgaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguauuccgacagaagguggugcuuugauggggaaaggaacaaccagguguuggaggagaacauggacguagagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacacuugacgcugagagcccagagugcucuggauaacuuggucauguugcacaauuccgaacaaggaggaaaagccuacagacaugcuauggaggaacuaccagacaccauagaaacauugaugcuucuagcuuugauagcuguguugacugguggagugaugcuguucuuccuaucaggaaaaggucuagggaaaacauccauuggcuugcucugugugacggccucaagcgcacuguuauggauggccaguguggagccccauuggauagcggccuccaucauacuagaguucuucuugauggugcugcucauuccagagccagacagacagcgcacuccacaggacaaccagcuagcauauguggugauagguuuguuauucaugauacugacaguggcagccaaugagaugggauuauuggaaaccacaaagagagaccuggggauuggccauguggccgcagaaaaccaccaacaugccacgaugcuggacguagaccuacguccagccucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggagucccacuucucgccuuagggugcuauucccaggugaacccauugacacugacagcggcaguguugauguuaguggcucauuaugccauaauuggaccaggacugcaagcaaaggccacuagagaagcucaaaaaaggacagcggccggaauaaugaaaaauccaacuguagacgggauuguugcuauagacuuggauccugugguuuaugaugcaaaauuugaaaaacagcuaggccaaauaaugcuacugauacuuuguacaucacaaauucucuugaugcggaccacaugggccuugugugaauccaucacacuggcgacuggacccuugaccacucucugggagggaucuccaggaaaauucuggaauaccacgauagcagugucuauggcaaacaucuucaggggaaguuaucuagcaggagcaggucuggcuuucucauugaugaaaucuuuaggaggagguaggagagguacgggagcucaaggggaaacacugggagagaaauggaaaagacaguuaaaccaacugagcaagccagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaagggaaagucauagaccucgguuguggaagggguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuuuugugugauauuggugaguccucuccgaauccaacuauagaagaaggaagaacguuacguguucuaaaaaugguggaaccauggcucagaggaaaccaauucugcauaaaaauccuaaauccuuauaugccaagugugguagaaacucuggagcaaaugcaaagaaaacauggagggaugcuagugcgaaacccacucucaagaaauuccacccaugaaauguacuggguuucauguggaacaggaaauauugugucggcagugaacaugacauccagaauguuacugaaucgauucacaauggcucacaggaagccaacauaugaaagagacguggacuuaggcgcuggaacaagacaugugacaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuaugguaaauggaguagugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguugugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcauagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacaucaauuuuuaagcugaccuaucaaaauaagguggugagggugcaaagaccagcaaaaaauggaaccgugauggauguuauaucuagacgugaccagagaggaaguggacaggucggaacuuauggcuuaaacacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcuaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccaguugaucaugaaggaugggagggaaauaguggugccaugccgcaaccaagaugaacuuguaggcagggcuagaguaucacaaggcgccggauggagccugagagaaacugcuugccuaggcaagucauaugcacaaauguggcaguugauguacuuccacaggagagaccugagacuagcggcuaacgcuaucuguucagccgucccaguugauugggucccaaccagccgcacaaccuggucaauucaugcccaccaccaauggaugacaacagaagacauguuaucaguguggaauaggguuuggauagaggaaaacccauggauggaggacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaagggguacucugguaa

SEQ ID NO: 5528 - RNA, 9879 nt, Artificial Sequence
  derived and/or modified CDS sequence (wt) from DENV-1__KF973455__SS-prME
uccgugaccaugcuccucaugcugcugcccacagcccuggcguuccauuugaccacacgggggggagagccacacaugauaguuaguaagcaugaaagaggaaagucacucuuguuuaagaccucuacaggugucaacaugugcacucucauugcgauggaccugggagaguuaugugaggacacaaugaccuacaaauguccccggauuacugaggcggaaccagaugacguugacugcuggugcaaugccacagacacaugggugaccuaugggacguguucucaaaccggcgaacaccgacgagauaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcuaaugcuggugacaccaucaauggccaugcgaugcgugggaauaggcaacagagacuucguugaaggacugucaggagcaacguggguggaugugguauuggagcauggaagcugcgucaccaccauggcaaaaaauaaaccaaccuuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacgcuuguggacagaggcugggguaaugguugcggacuauucggaaagggaagccuauugacgugugccaaguucaagugugugacaaaacuagaaggaaagauaguucaauaugaaaacuugaaauauucagugauagucacuguccacacuggggaccagcaccagguaggaaacgagacuacagaacauggaacaauugcaaccauaacaccucaagcucccacgucggaaauacagcugacugacuacggagcccucgcauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguaguaguacugggaucacaggaaggagcaaugcacacugcguugacuggggcgacagaaauccagacgucaggaacgacaacaauuuuugcaggacacuugaaaugcagacuaaaaauggauaaauugacuuuaaaggggacaucauaugugaugugcacaggcucauuuaagcuagagaaggaaguggcugagacccaacauggaacuguucuagugcaggucaaauacgaaggaacagacgcgccaugcaagauccccuuuucgacccaagaugagaaaggagugacccagaauggaagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaacugcccgaggagcacgaaggauggcuauccugggagacaccgcaugggacuucggcucuauaggaggaguguucacaucuguaggaaaauugguacaccagguuuuuggaaccgcauaugggguucuguucagcgguguuucuuggaccaugaaaauaggaauagggauucugcugacaugguugggauuaaauucaaggagcacgucacuuucaaugacgugcauugcaguuggcaugguuacacuguaccuaggagucaugguucaagcggacucgggauguguaaucaacuggaagggcagagaacuuaaauguggaaguggcauuuuugucacuaaugaaguccacacuuggacagagcaauacaaauuccaggcugauuccccaaaaagacugucagcagccauuggaaaggcaugggaggagggcguguguggaauucgaucagccacgcgucuugagaacaucauguggaagcaaauaucaaaugaauugaaccacauucuacucgaaaaugacaugaaauucacagugguuguaggagaugcuaauggaauuuuggcccaagggaaaaaaaugauuaggccacaacccauggaacacaaauacucauggaaaaguuggggaaaagcuaaaaucauaggagcagacauacaaaauaccaccuucaucaucgacggcccagauaccccagaaugccccgaugaccaaagagcguggaacauuugggaaguugaggacuauggguuuggaauuuucacgacuaacauauggcuaaaauugcgugacuccuacacccaaaugugugaccaccggcuaaugucagcugccaucaaggacagcaaggcaguccaugcugacaugggguacuggauagaaagugaaaagaacgaaaccuggaaguuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucgauggucucugcagggucaggagaaguggacaguuuuucauugggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaauugagaccaauguucgcuguugggauauuguuucgcagacuaacauccagagaaguucuucuucucacgauuggauuaagccugguggcauccguagagcuaccaaauucuuuggaggagcuaggggauggacuugcaauggguaucaugauguuaaaauuauugacugaauuucagccacaccaguuauggaccacuuuacugucucugacauuuaucaaaacaacucuuucacuggauuaugcauggaaaacaacggcuauggcacugucaaucgugucucucuuuccuauaugccugucuacgaccucccaaaaaacaacauggcuuccggugcuguuaggaucuuuuggaugcaaaccauuaaccauguaucuuauaacagaaaacaaaaucuggggaaggaaaaguuggcccaucaaugaaggaauuauggcuauuggaauagucagcauucuacugaguucacuccuaaaaaaugaugugccguuggccggcccacuaauagcuggaggcaugcuaauagcauguuaugucauauccggaagcucagccgauuuaucauuggagaaagcggcugagguguccugggaacaagaagcagaacacucagguaccucacacaacauauuaguagagguccaagaugauggaacuaugagaauaaaagaugaagagaaggaugacacacucacuauacuccuuaaagcaacuuugcuagcagucucaggaguguacccaaugucaauaccagcaacucuuuuugugugguauuucuggcagaaaaagaaacagagaucaggaguguuaugggacacacccagcccuccggaaguggaaagagcaguucuugaugauggcaucuauagaaucuugcaaagaggacuguugggcagaucccaagugggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaagucggagccauagcucuagauuuuaaacccggcacaucuggaucucccauugugaacagagagggaaaaauaguaggucuuuauggaaauggaguggugacaacaaguggaaccuacgucagugccauugcucaagcuaaagcaucacaggaagggccucuaccagagauugaggacgagguguucaagaaaagaaacuuaacaauaauggaccugcauccaggaucagggaaaacaagaagauaucuuccggccauaguccgugaggccauaaaaaggaagcugcguacguuaaucuuggcucccacaagaguugucgccucugaaauggcagaggcgcucaagggaaugccaauaagauaucagacaacagcagugaagagugaacacacaggaagggagauaguagaccucaugugccacgcuacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguagaggccuuuccacagaguaaugcaguuauccaagaugaggaaagagacauuccugagagaucauggaacucaggcuaugacuggaucacugauuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaacaaugauugggacuauguugucacaacagacauuuccgaaaugggggcaaauuuccgggccgacaggguaauagacccaaggcgaugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagccuuugaauaacgaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguauuccgacagaagguggugcuuugauggggaaaggaacaaccagguguuggaggagaacauggacguagagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacacuugacgcugagagcccagaaugcucuggauaacuuggucauguugcacaauuccgaacaaggaggaaaagccuacagacaugcuauggaggaacuaccagacaccauagaaacauugaugcuucuagcuuugauagcuguguugacugguggagugaugcuguucuuccuaucaggaaaaggucuagggaaaacauccauuggcuugcucugugugacggccucaagcgcacuguuauggauggccaguguggagccccauuggauagcggccuccaucauacuagaguucuucuugauggugcugcucauuccagagccagacagacagcgcacuccacaggacaaccagcuagcauauguggugauagguuuguuauucaugauacugacaguggcagccaaugagaugggauuauuggaaaccacaaagagagaccuggggauuggccauguggccgcagaaaaccaccaacaugccacgaugcuggacguagaccuacauccagccucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggagucccacuucucgccuuagggugcuauucccaggugaacccauugacacugacagcggcaguguugauguuaguggcucauuaugccauaauuggaccaggacugcaagcaaaggccacuagagaagcucaaaaaaggacagcggccggaauaaugaaaaauccaacuguagacgggauuguugcuauagacuuggauccugugguuuaugaugcaaaauuugaaaaacagcuaggccaaauaaugcuacugauacuuuguacaucacaaauucucuugaugcggaccacaugggccuugugugaauccaucacacuggcgacuggacccuugaccacucucugggagggaucuccaggaaaauucuggaauaccacgauagcagugucuauggcaaacaucuucaggggaaguuaucuagcaggagcaggucuggcuuucucauugaugaaaucuuuaggaggagguaggagagguacgggagcucaaggggaaacacugggagagaaauggaaaagacaguuaaaccaacugagcaagccagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaagggaaagucauagaccucgguuguggaagggguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuuuugugugauauuggugaguccucuccgaauccaacuauagaagaaggaagaacguuacguguucuaaaaaugguggaaccauggcucagaggaaaccaauucugcauaaaaauccuaaauccuuauaugccaagugugguagaaacucuggagcaaaugcaaagaaaacauggagggaugcuagugcgaaacccacucucaagaaauuccacccaugaaauguacuggguuucauguggaacaggaaauauugugucggcagugaacaugacauccagaauguuacugaaucgauucacaauggcucacaggaagccaacauaugaaagagacguggacuuaggcgcuggaacaagacaugugacaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuaugguaaauggaguagugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguugugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcauagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacaucaauuuuuaagcugaccuaucaaaauaagguggugagggugcaaagaccagcaaaaaauggaaccgugauggauguuauaucuagacgugaccagagaggaaguggacaggucggaacuuauggcuuaaacacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcuaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccaguugaucaugaaggaugggagggaaauaguggugccaugccgcaaccaagaugaacuuguaggcagggcuagaguaucacaaggcgccggauggagccugagagaaacugcuugccuaggcaagucauaugcacaaauguggcaguugauguacuuccacaggagagaccugagacuagcggcuaacgcuaucuguucagccgucccaguugauugggucccaaccagccgcacaaccuggucaauucaugcccaccaccaauggaugacaacagaagacauguuaucaguguggaauaggguuuggauagaggaaaacccauggauggaggacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5529 - RNA, 9879 nt, Artificial Sequence
  derived and/or modified CDS sequence (wt) from DENV-1__KF973456__SS-prME
uccgugaccaugcuccucaugcugcugcccacagcccuggcguuccauuugaccacacgggggggagagccacacaugauaguuaguaagcaugaaagaggaaagucacucuuguuuaagaccucuacaggugucaacaugugcacucucauugcgauggaccugggagaguuaugugaggacacaaugaccuacaaauguccccggauuacugaggcggaaccagaugacguugacugcuggugcaaugccacagacacaugggugaccuaugggacguguucucaaaccggcgaacaccgacgagauaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcuaaugcuggugacaccaucaauggccaugcgaugcgugggaauaggcaacagagacuucguugaaggacugucaggagcaacguggguggaugugguauuggagcauggaagcugcgucaccaccauggcaaaaaauaaaccaaccuuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacgcuuguggacagaggcugggguaaugguugcggacuauucggaaagggaagccuauugacgugugccaaguucaagugugugacaaaacuagaaggaaagauaguucaauaugaaaacuugaaauauucagugauagucacuguccacacuggggaccagcaccagguaggaaacgagacuacagaacauggaacaauugcaaccauaacaccucaagcucccacgucggaaauacagcugacugacuacggagcccucgcauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguaguaguacugggaucacaggaaggagcaaugcacacugcguugacuggggcgacagaaauccagacgucaggaacgacaacaauuuuugcaggacacuugaaaugcagacuaaaaauggauaaauugacuuuaaaggggacaucauaugugaugugcacaggcucauuuaagcuagagaaggaaguggcugagacccaacauggaacuguucuagugcaggucaaauacgaaggaacagacgcgccaugcaagauccccuuuucgacccaagaugagaaaggagugacccagaauggaagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaacugcccgaggagcacgaaggauggcuauccugggagacaccgcaugggacuucggcucuauaggaggaguguucacaucuguaggaaaauugguacaccagguuuuuggaaccgcauaugggguucuguucagcgguguuucuuggaccaugaaaauaggaauagggauucugcugacaugguugggauuaaauucaaggagcacgucacuuucaaugacgugcauugcaguuggcaugguuacacuguaccuaggagucaugguucaagcggacucgggauguguaaucaacuggaagggcagagaacuuaaauguggaaguggcauuuuugucacuaaugaaguccacacuuggacagagcaauacaaauuccaggcugauuccccaaaaagacugucagcagccauuggaaaggcaugggaggagggcguguguggaauucgaucagccacgcgucuugagaacaucauguggaagcaaauaucaaaugaauugaaccacauucuacucgaaaaugacaugaaauucacagugguuguaggagaugcuaauggaauuuuggcccaagggaaaaaaaugauuaggccacaacccauggaacacaaauacucauggaaaaguuggggaaaagcuaaaaucauaggagcagacauacaaaauaccaccuucaucaucgacggcccagauaccccagaaugccccgaugaccaaagagcguggaacauuugggaaguugaggacuauggguuuggaauuuucacgacuaacauauggcuaaaauugcgugacuccuacacccaaaugugugaccaccggcuaaugucagcugccaucaaggacagcaaggcaguccaugcugacaugggguacuggauagaaagugaaaagaacgaaaccuggaaguuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucgauggucucugcagggucaggagaaguggacaguuuuucauugggaauacuaugcguaucaauaaugauugaagaagugaugagauccagauggaguagaaagaugcugaugacuggaacacuggcuguuuuccuccuucuuauaaugggacaacugacauggaaugauuugauuagguuaugcaucaugguuggagcuaaugcuucagacaggauggggaugggaacaacguaccuagccuugauggcuacuuucaaauugagaccaauguucgcuguugggauauuguuucgcagacuaacauccagagaaguucuucuucucacgauuggauuaagccugguggcauccguagagcuaccaaauucuuuggaggagcuaggggauggacuugcaauggguaucaugauguuaaaauuauugacugaauuucagccacaccaguuauggaccacuuuacugucucugacauuuaucaaaacaacucuuucacuggauuaugcauggaaaacaacggcuauggcacugucaaucgugucucucuuuccuauaugccugucuacgaccucccaaaaaacaacauggcuuccggugcuguuaggaucuuuuggaugcaaaccauuaaccauguaucuuauaacagaaaacaaaaucuggggaaggaaaaguuggcccaucaaugaaggaauuauggcuauuggaauagucagcauucuacugaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacucagguaccucacacaacauauuaguagagguccaagaugauggaacuaugagaauaaaagaugaagagaaggaugacacacucacuauacuccuuaaagcaacuuugcuagcagucucaggaguguacccaaugucaauaccagcaacucuuuuugugugguauuucuggcagaaaaagaaacagagaucaggaguguuaugggacacacccagcccuccggaaguggaaagagcaguucuugaugauggcaucuauagaaucuugcaaagaggacuguugggcagaucccaagugggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaagucggagccauagcucuagauuuuaaacccggcacaucuggaucucccauugugaacagagagggaaaaauaguaggucuuuauggaaauggaguggugacaacaaguggaaccuacgucagugccauugcucaagcuaaagcaucacaggaagggccucuaccagagauugaggacgagguguucaagaaaagaaacuuaacaauaauggaccugcauccaggaucagggaaaacaagaagauaucuuccggccauaguccgugaggccauaaaaaggaagcugcguacguuaaucuuggcucccacaagaguugucgccucugaaauggcagaggcgcucaagggaaugccaauaagauaucagacaacagcagugaagagugaacacacaggaagggagauaguagaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguagaggccuuuccacagaguaaugcaguuauccaagaugaggaaagagacauuccugagagaucauggaacucaggcuaugacuggaucacugauuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaacaaugauugggacuauguugucacaacagacauuuccgaaaugggggcaaauuuccgggccgacaggguaauagacccaaggcgaugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagccuuugaauaacgaugaggaucacgcucauuggacagaagcaaaaaugcuccuugacaauauaaacacaccagaagggaucaucccagcccucuuugagccagagagagaaaagagugcagcaauagauggggaguacagacugcggggagaagcaaggaaaacguucguggagcucaugagaagaggagaucuaccaguuuggcuauccuacaaaguagccucagaagguuuccaguauuccgacagaagguggugcuuugauggggaaaggaacaaccagguguuggaggagaacauggacguagagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacacuugacgcugagagcccagaaugcucuggauaacuuggucauguugcacaauuccgaacaaggaggaaaagccuacagacaugcuauggaggaacuaccagacaccauagaaacauugaugcuucuagcuuugauagcuguguugacugguggagugaugcuguucuuccuaucaggaaaaggucuagggaaaacauccauuggcuugcucugugugacggccucaagcgcacuguuauggauggccaguguggagccccauuggauagcggccuccaucauacuagaguucuucuugauggugcugcucauuccagagccagacagacagcgcacuccacaggacaaccagcuagcauauguggugauagguuuguuauucaugauacugacaguggcagccaaugagaugggauuauuggaaaccacaaagagagaccuggggauuggccauguggccgcagaaaaccaccaacaugccacgaugcuggacguagaccuacguccagccucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggagucccacuucucgccuuagggugcuauucccaggugaacccauugacacugacagcggcaguguugauguuaguggcucauuaugccauaauuggaccaggacugcaagcaaaggccacuagagaagcucaaaaaaggacagcggccggaauaaugaaaaauccaacuguagacgggauuguugcuauagacuuggauccugugguuuaugaugcaaaauuugaaaaacagcuaggccaaauaaugcuacugauacuuuguacaucacaaauucucuugaugcggaccacaugggccuugugugaauccaucacacuggcgacuggacccuugaccacucucugggagggaucuccaggaaaauucuggaauaccacgauagcagugucuauggcaaacaucuucaggggaaguuaucuagcaggagcaggucuggcuuucucauugaugaaaucuuuaggaggagguaggagagguacgggagcucaaggggaaacacugggagagaaauggaaaagacaguuaaaccaacugagcaagccagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaagggaaagucauagaccucgguuguggaagggguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuuuugugugauauuggugaguccucuccgaauccaacuauagaagaaggaagaacguuacguguucuaaaaaugguggaaccauggcucagaggaaaccaauucugcauaaaaauccuaaauccuuauaugccaagugugguagaaacucuggagcaaaugcaaagaaaacauggagggaugcuagugcgaaacccacucucaagaaauuccacccaugaaauguacuggguuucauguggaacaggaaauauugugucggcagugaacaugacauccagaauguuacugaaucgauucacaauggcucacaggaagccaacauaugaaagagacguggacuuaggcgcuggaacaagacaugugacaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuaugguaaauggaguagugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguugugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcauagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacaucaauuuuuaagcugaccuaucaaaauaagguggugagggugcaaagaccagcaaaaaauggaaccgugauggauguuauaucuagacgugaccagagaggaaguggacaggucggaacuuauggcuuaaacacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcuaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccaguugaucaugaaggaugggagggaaauaguggugccaugccgcaaccaagaugaacuuguaggcagggcuagaguaucacaaggcgccggauggagccugagagaaacugcuugccuaggcaagucauaugcacaaauguggcaguugauguacuuccacaggagagaccugagacuagcggcuaacgcuaucuguucagccgucccaguugauugggucccaaccagccgcacaaccuggucaauucaugcccaccaccaauggaugacaacagaagacauguuaucaguguggaauaggguuuggauagaggaaaacccauggauggaggacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5530 - RNA, 9879 nt, Artificial Sequence
  derived and/or modified CDS sequence (wt) from DENV-1__KF973459__SS-prME
uccgugaccaugcuucucaugcugcugcccacagcucuggcguuccauuugaccacacgagggggagagccacacaugauaguuaguaagcaggaaagaggaaagucacucuuguuuaagaccucugcaggugucaauaugugcacucucauugcgauggacuuaggagaguuaugugaggacacacugaccuacaaaugcccccagaucacugaggcggaaccagaugacguugacugcuggugcaaugccacagacacaugggugaccuaugggacguguucucaaaccggcgaacaccgacgagacaaacgcuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccagccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcuggggcaauggcuguggacuauucggaaagggaagccuauugacgugugcuaaguucaagugugugacaaaacuagaaggaaagauaguacaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggccucaacaucccaagagaccuggaacagacaagauuugcugguuacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugauguguacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagacugauaacagccaaucccauagucacugacaaagaaaaaccagucaacauugagacugaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacauccgugggaaaauugguacaccagguuuuuggaaccgcauaugggguucuguucagcgguguuucuuggaccaugaaaauaggaauagggauucugcugacauggcugggauuaaauucaaggagcacgucacuuucgaugacgugcaucgcaguuggcaugguuacacuauaccuaggagucaugguucaagcggacucgggaugugugaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaauuauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaagugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuaucauuaggaauacuaugcgcaucaauaaugauugaagaagugaugagauccagauggaguagaaagaugcugaugacuggaacacuggcuguuuuccuccuucuuauaaugggacaacugacauggaaugaucugauuaggcuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucauaucucucuuucccuuaugccugucuacgaccucccaaaaaacaacauggcuuccggugcuguuaggaucuuuuggaugcaaaccguuaaccauguuucuuauaacagaaaacaaaaucuggggaaggaaaagcuggccccucaaugaaggaaucauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucaccauacuccuuaaagcaacuuugcuggcagugucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagagggcuguugggcaggucccaaguaggagugggaguuuuccaagacggcguguuccacacaauguggcacgucaccaggggagcuguccuuauguaccaagggaagaggcuggaaccaagcugggccagugucaaaaaggauuugauuucauauggaggagguuggagguuucaaggaucauggaacacgggagaagaagugcaggugauagcuguugaaccaggaaaaaaccccaaaaauguacagacaacaccggguaccuucaagacuccugaaggugaaguuggagccauagcucuagauuuuaaacccggcacaucuggaucuccuaucgugaacagagagggaaaaauaguaggucuuuauggaaauggaguggugacaacaaguggaaccuacguuagugccauugcccaagcuaaaguaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuucaugacagccacucccccaggaucgguggaggcuuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggauuauguugucacaacagacauuuccgaaaugggggcaaauuuccgggccgacaggguaauagacccaaggcggugcuugaaaccgguaauacuaaaagaugguccagagcgugucauucuagccggaccgaugccagugaccguggccagugcugcccagaggagaggaagaauuggaaggaaccaaaauaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcuggcuggacgccagaacauacucugauccauuggcccugcgugaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggaaccccauuggauagcggccuccaucauacuagaguucuuucugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagcugccgaaaaccaucaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugacacaaaauuugaaaaacagcuaggccaaauaauguuacugauacuuugcacaucacagauccucuuaaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaucuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacacgaggaaccuaucccaauggcgaccuauggauggaaccuaguaaagcuacacucuggaaaagauguauuuuucaugccaccugagaaaugugacacccuucugugugauauuggugaguccucuccgaauccaaccauagaagaaggaagaacguuacguguuuuaaaaaugguggaaccauggcuaagaggaaaccaauucugcauaaaaauccuaaauccuuacaugccaagugugguagaaacucuggagcagaugcaaagaaaauauggagggaugcuagugcgaaacccacucucaagaaauuccacccaugaaauguacuggguuucauguggaacaggaaacauugugucggcagugaacaugacauccagaaugcuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggagugguaagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucgaacgcagcaauaggagcaguguucguugaugaaaaccaauggaacucagcaaaagaagcaguggaagacgaaagguuuugggaucucgugcacagagagagggagcuucauaaacagggaaaaugugccacgugcgucuacaacaugauggggaagagagagaaaaaacuaggagaguuuggaaaggcaaaaggaagucgugcaauaugguacauguggcugggagcacgcuuucuggaguucgaagcccuugguuucaugaaugaggaucacugguuuagcagagagaauucacucaguggaguggagggagaaggacugcacaaacuuggauacauacucagagacauaucaaagauuccggggggaaacauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggaugucauauccagacgugaccagagaggaaguggacaggucggaacuuauggcuuaaauacuuucacuaacauggagguccaacuaauaagacaaauggaguccgaaggaaucuuuuuacccagcgaauuggaaacccccaaucuagcuaagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuagugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacccauguauccaguugggaagaaguuccauaccuagggaaaagggaagaucaaugguguggaucccugauaggcuugacagcgagggccaccugggccacuaacauacaaguggccauaaaccaagugagaagacucaucgggaaugagaauuaucuagauuauaugacaucaaugaagagauucaagaaugagagugaucccgaaggggcacucugguga

SEQ ID NO: 5531 - RNA, 9879 nt, Artificial Sequence
  derived and/or modified CDS sequence (wt) from DENV-1__KF973460__SS-prME
uccgugaccaugcuccucaugcugcugcccacagcccuggcguuccauuugaccacacgggggggagagccacacaugauaguuaguaagcaugaaagaggaaagucacucuuguuuaagaccucuacaggugucaacaugugcacucucauugcgauggaccugggagaguuaugugaggacacaaugaccuacaaauguccccggauuacugaggcggaaccagaugacguugacugcuggugcaaugccacagacacaugggugaccuaugggacguguucucaaaccggcgaacaccgacgagauaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcuaaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaaccuuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacgcuuguggacagaggcugggguaaugguugcggacuauucggaaagggaagccuauugacgugugccaaguucaagugugugacaaaacuagaaggaaagauaguucaauaugaaaacuugaaauauucagugauagucacuguccacacuggggaccagcaccaggugggaaacgagacuacagaacauggaacaauugcaaccauaacaccucaagcucccacgucggaaauacagcugacugacuacggagcccucgcauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaauuuuugcaggacacuugaaaugcagacuaaaaauggauaaauugacuuuaaaggggacaucauaugugaugugcacaggcucauuuaagcuagagaaggaaguggcugagacccaacauggaacuguucuagugcaggucaaauacgaaggaacagacgcgccaugcaagauccccuuuucgacccaagaugagaaaggagugacccagaauggaagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguuugaagcaacugcccgaggagcacgaaggauggcuauccugggagacaccgcaugggacuucggcucuauaggaggaguguucacaucuguaggaaaauugguacaccagguuuuuggaaccgcauaugggguucuguucagcgguguuucuuggaccaugaaaauaggaauagggauucugcugacaugguugggauuaaauucaaggagcacgucacuuucaaugacgugcauugcaguuggcaugguuacacuguaccuaggagucaugguucaagcggauucgggauguguaaucaacuggaagggcagagaacuuaaauguggaaguggcauuuuugucacuaaugaaguccacacuuggacagagcaauacaaauuccaggcugauuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgaugaccaaagagcguggaacauuugggaaguugaggacuauggguuuggaauuuucacgacuaacauauggcuaaaauugcgugacuccuacacccaaaugugugaccaccggcuaaugucagcugccaucaaggacagcaaggcaguccaugcugacaugggguacuggauagaaagugaaaagaacgaaaccuggaaguuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucgauggucucugcagggucaggagaaguggacagucuuucauugggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaauugagaccaauguucgcuguugggauauuguuucgcagacuaacauccagagaaguucuucuucucacgauuggauuaagccugguggcauccguagagcuaccaaauucuuuggaggagcuaggggauggacuugcaauggguaucaugauguuaaaauuauugacugaauuucagccacaccaguuauggaccaccuuacugucucugacauuuaucaaaacaacucuuucacuggauuaugcauggaaaacaacggcuauggcacugucaaucgugucucucuuuccuuuaugccugucuacgaccucccaaaaaacaacauggcuuccggugcuguuaggaucuuuuggaugcaaaccauuaaccauguauuuuauaacagaaaacaaaaucuggggaaggaaaaguuggcccaucaaugaaggaauuauggcuauuggaauagucagcauucuacugaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacucagguaccucacacaacauauuaguagagguccaagaugauggaacuaugagaauaaaagaugaagagaaggaugacacacucacuauacuccuuaaagcaacuuugcuagcagucucaggaguguacccaaugucaauaccagcaacucuuuuugugugguauuucuggcagaaaaagaaacagagaucaggaguguuaugggacacacccagcccuccggaaguggaaagagcaguucuugaugauggcaucuauagaaucuugcaaagaggacuguugggcagaucccaagugggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaagucggagccauagcucuagauuuuaaacccggcacaucuggaucucccauugugaacagagagggaaaaauaguaggucuuuauggaaauggaguggugacaacaaguggaaccuacgucagugccauugcucaagcuaaagcaucacaggaagggccucuaccagagauugaggacgagguguucaagaaaagaaacuuaacaauaauggaccugcauccaggaucaggaaaaacaagaagauaucuuccggccauaguccgugaggccauaaaaaggaagcugcguacguuaaucuuggcucccacaagaguugucgccucugaaauggcagaggcgcucaagggaaugccaauaagauaucagacaacagcagugaagagugaacacacaggaagggagauaguagaccucaugugccacgccacuuuuaccaugcgucucuuauccccaguaagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguagaggccuuuccacagaguaaugcaguuauccaagaugaggaaagagacauuccugagagaucauggaacucaggcuacgacuggaucacugauuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaacaaugauugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagccuuugaauaacgaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguauuccgacagaagguggugcuuugauggggaaaggaacaaccagguguuggaggagaacauggacguagagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacacuugacgcugagagcccagaaugcucuggauaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuucuugauggugcugcucauuccagagccagacagacagcgcacuccacaggacaaccagcuagcauauguggugauagguuuguuauucaugauacugacaguggcagccaaugagaugggauuauuggaaaccacaaagagagaccuggggauuggccauguggccgccgaaaaccaccaacaugccacgaugcuggacguagaccuacguccagccucagccuggacucucuaugcaguagccacaacaguuaucacucccaugaugagacacacaauugaaaauacaacggcaaacaucucccugacagccauugcaaaucaggcagcuauauugaugggacuugacaagggauggccaauaucgaagauggacauaggagucccacuucucgccuuagggugcuauucccaggugaacccauugacacugacagcggcaguguugauguuaguggcucauuaugccauaauuggaccaggacugcaagcaaaggccacuagagaagcucaaaaaaggacagcggccggaauaaugaaaaauccaacuguagacgggauuguugcuauagacuuggauccugugguuuaugaugcaaaauuugaaaaacagcuaggccaaauaaugcuacugauacuuuguauaucacaaauucucuugaugcggaccacaugggccuugugugaauccaucacacuggcgacuggacccuugaccacucuuugggagggaucuccaggaaaauucuggaauaccacgauagcagugucuauggcaaacaucuucaggggaaguuaucuagcaggagcaggucuggcuuucucauugaugaaaucuuuaggaggagguaggagagguacgggagcucaaggggaaacacugggagagaaauggaaaagacaguuaaaccaacugagcaagccagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaagggaaagucauagaccucgguuguggaagggguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuuuugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaauauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuaugguaaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguugugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcauagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacaucaauuuuuaagcugaccuaucaaaauaagguggugagggugcaaagaccagcaaaaaauggaaccgugauggauguuauaucuagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccaguugaucaugaaggaugggagggaaauaguggugccaugccgcaaccaagaugaacuuguaggcagggcuagaguaucacaaggcgccggauggagccugagagaaacugcuugccuaggcaagucauaugcacaaauguggcaguugauguacuuccacaggagagaccugagacuagcggcuaacgcuaucuguucagccgucccaguugacugggucccaaccagccgcacaaccuggucaauucaugcccaccaccaauggaugacaacagaagacauguuaucaguguggaauaggguuuggauagaggaaaacccauggauggaggacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaguuaucuagauuacaugacaucaaugaagagauucaagaaugagagugaucccgaaggggcacucugguaa

SEQ ID NO: 5532 - RNA, 9879 nt, Artificial Sequence
  derived and/or modified CDS sequence (wt) from DENV-1__KF973461__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacgcuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacagaggucacgaacccagccauuuugcgcaaacugugcauugaagcuaaaauaucaaacaccaccaccgauucaagauguccaacacaaggagaggcuacauugguggaagaacaagacgcgaacuuugugugucgccgaacguuuguggacagaggcuggggcaauggcuguggacuauucggaaagggaagccuauugacgugugcuaaguucaagugugugacaaaacuagaaggaaagauaguccaauaugaaaacuuaaaauauucagugauagucacuguccauacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcugguuacauucaagacagcucaugcaaagaaacaggagguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagacugauaacagccaaucccauagucacugacaaagaaaaaccagucaacauugagacugaaccaccuuuuggugagaguuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccaugggaggaguguucacauccgugggaaaauugguacaccagguuuuuggaaccgcauaugggguucuguucagcgguguuucuuggaccaugaaaauaggaauagggauucugcugacauggcugggauuaaauucaaggagcacgucacuuucgaugacgugcaucgcaguuggcaugguuacauuauaccuaggagucaugguucaagcggacucgggaugugugaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugaguugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuaggcuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaauaacggcuauggcacugucaaucauaucucucuuucccuuaugccugucuacgaccucccaaaaaacaacauggcuuccggugcuguuaggaucuuuuggaugcaaaccguuaaccauguuucuuauaacagaaaacaaaaucuggggaaggaaaaguuggccccucaaugaaggaaucauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucaccauacuccuuaaagcaacuuugcuggcagugucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugauuucauauggaggagguuggagguuucaaggaucauggaacacgggagaagaagugcaggugauagcuguugaaccaggaaaaaaccccaaaaauguacagacaacaccggguaccuucaagacuccugaaggugagguuggagccauagcucuagauuuuaaacccggcacaucuggaucuccuaucgugaacagagagggaaaaauagugggucuuuauggaaauggaguggugacaacaaguggaaccuacguuagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuucaugacagccacucccccaggaucgguggaggcuuucccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggauuauguugucacaacagacaucuccgaaaugggggcaaauuuccgggccgacaggguaauagacccaaggcggugcuugaaaccgguaauacuaaaagaugguccagagcgugucauucuagccggaccgaugccagugaccguggccagugcugcccagaggagaggaagaauuggaaggaaccaaaauaaggaaggugaucaguacguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaacugcgaccccgcugguuggacgccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcauaauuccgaacaaggaggaaaagccuauagacaugcuauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggaaccccauuggauagcggccuccaucauacuagaguucuuucugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagcugccgaaaaccaucaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugauacaaaauuugaaaaacagcuaggccaaauaauguuacugauacuuuguacgucacagauccucuuaaugcggaccacaugggccuugugugaauccaucacacuagcuacuggaccccuaaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugaguaagucagaauucaacaucuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuucaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaauauggagggaugcuagugcgaaacccacucucaagaaauuccacccaugaaauguacuggguuucaugugggacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggagugguaagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucgaacgcagcaauaggagcaguguucguugaugaaaaccaauggaacucagcaaaagaagcaguggaagacgaaagguuuugggaucucgugcgcagagagagggagcuucauaaacagggaaaaugugccacgugcgucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggagggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaaucuuuaagcugacuuaucaaaacaaaguggugagggugcaaagaccagcaaaaaacggaaccgugauggaugucauauccagacgugaccagagaggaaguggacaggucggaacuuauggcuuaaauacuuucacuaacauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuagugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggagaacccauggauggaggacaaaacccauguauccaguugggaagaaguuccauaccuagggaaaagggaagaucaaugguguggaucccugauaggcuugacagcgagggccaccugggccacuaacauacaaguggccauaaaccaagugagaagacucaucgggaaugagaauuaucuagauuauaugacaucaaugaagagauucaagaaugagagugaucccgaaggggcacucugguga

SEQ ID NO: 5533 - RNA, 9879 nt, Artificial Sequence
  derived and/or modified CDS sequence (wt) from DENV-1__KF973462__SS-prME
uccgugaccaugcuucucaugcugcugcccacagcucuggcguuccauuugaccacacgagggggagagccacacaugauaguuaguaagcaggaaagaggaaagucacucuuguuuaagaccucugcaggugucaauaugugcacucucauugcgauggacuuaggagaguuaugugaggacacacugaccuacaaaugcccccagaucauugaggcggaaccagaugacguugacugcuggugcaaugccacagacacaugggugaccuaugggacguguucucaaaccggcgaacaccgacgagacaaacgcuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacgaacccagccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcuggggcaauggcuguggacuauucggaaagggaagccuauugacgugugcuaaguucaagugugugacaaaacuagaaggaaagauaguacaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggccucaacaucccaagagaccuggaacagacaagauuugcugguuacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugauguguacaggcucauuuaagcuagagaaggaaauggcugagacccagcauggaacuguucuagugcaggucaaauacgaaggaacagacgcgccaugcaagauccccuuuucgacccaagaugagaaaggagugacccagaaugggagacugauaacagccaaucccauagucacugacaaagaaaaaccagucaacauugagacugaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacauccgugggaaaauugguacaccagguuuuuggaaccgcauaugggguucuguucagcgguguuucuuggaccaugaaaauaggaauagggauucugcugacauggcugggauuaaauucaaggagcacgucacuuucgaugacgugcaucgcaguuggcaugguuacacuauaccuaggagucaugguucaagcggacucgggaugugugaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaauuauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaagugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuaggcuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucauaucucucuuucccuuaugccugucuacgaccucccaaaaaacaacauggcuuccggugcuguuaggaucuuuuggaugcaaaccguuaaccauguuucuuauaacagaaaacaaaaucuggggaaggaaaagcuggccccucaaugaaggaaucauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucaccauacuccuuaaagcaacuuugcuggcagugucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagagggcuguugggcaggucccaaguaggagugggaguuuuccaagacggcguguuccacacaauguggcacgucaccaggggagcuguccuuauguaccaagggaagaggcuggaaccaagcugggccagugucaaaaaggauuugauuucauauggaggagguuggagguuucaaggaucauggaacacgggagaagaagugcaggugauagcuguugaaccaggaaaaaaccccaaaaauguacagacaacaccggguaccuucaagacuccugaaggugaaguuggagccauagcucuagauuuuaaacccggcacaucuggaucuccuaucgugaacagagagggaaaaauaguaggucuuuauggaaauggaguggugacaacaaguggaaccuacguuagugccauugcccaagcuaaaguaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggcuuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggauuauguugucacaacagacauuuccgaaaugggggcaaauuuccgggccgacaggguaauagacccaaggcggugcuugaaaccgguaauacuaaaagaugguccagagcgugucauucuagccggaccgaugccagugaccguggccagugcugcccagaggagaggaagaauuggaaggaaccaaaauaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcuggcuggacgccagaacauacucugauccauuggcccugcgugaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuauagacaugcuauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggaaccccauuggauagcggccuccaucauacuagaguucuuucugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagcugccgaaaaccaucaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugacacaaaauuugaaaaacagcuaggccaaauaauguuacugauacuuuguacaucacagauccucuuaaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaucuacaaaaggaguggaauuauggagguggacagauccgaagccaaagagggacuaaaaagaggagaaacaaccaaacaugcagugucgagaggaacagccaaacugaggugguuuguggagaggaaccucgugaaaccagaagggaaagucauagaccucgguuguggaagagguggcuggucauauuauugugccgggcugaagaaagucacugaagugaagggauacacaaaaggaggaccuggacaugaggaaccuaucccaauggcgaccuauggauggaaccuaguaaggcuacacucuggaaaagauguauuuuucaugccaccugagaaaugugacacccuucugugugauauuggugaguccucuccgaauccaaccauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaauauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggagugguaagauugcucacaaaaccaugggauguuauccccauggucacacaaauagccaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucgaacgcagcaauaggagcaguguucguugaugaaaaccaauggaacucagcaaaagaagcaguggaagacgaaagguuuugggaucucgugcacagagagagggagcuucauaaacagggaaaaugugccacgugcgucuacaacaugauggggaagagagagaaaaaacuaggagaguuuggaaaggcaaaaggaagucgugcaauaugguacauguggcugggagcacgcuuucuggaguucgaagcccuugguuucaugaaugaggaucacugguuuagcagagagaauucacucaguggaguggagggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaauuuuuaagcugacuuaucaaaacaaaguggugagggugcaaagaccagcaaaaaacggaaccgugauggaugucauauccagacgugaccagagaggaaguggacaggucggaacuuauggcuuaaauacuuucacuaacauggagguccaacuaauaagacaaauggaguccgaaggaaucuuuuuacccagcgaauuggaaacccccaaucuagcuaagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaauaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuagugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacccauguauccaguugggaagaaguuccauaccuagggaaaagggaagaucaaugguguggaucccugauaggcuugacagcgagggccaccugggccacuaacauacaaguggccauaaaccaagugagaagacucaucgggaaugagaauuaucuagauuauaugacaucaaugaagagauucaagaaugagagugaucccgaaggggcacucugguga

SEQ ID NO: 5534 - RNA, 9879 nt, Artificial Sequence
  derived and/or modified CDS sequence (wt) from DENV-1__KF973463__SS-prME
uccguaaccaugcuccucaugcugaugcccacagcccuggcguuccauuugaccacacgggggggagagccacacaugauaguuaguaagcaugaaagaggaaaggcacucuuguuuaagaccucuacaggugucaacaugugcacucucauugcgauggacuugggagaguuaugugaggacacaaugaccuacaaauguccccggauuacugaggcggaaccagaugauguugacugcuggugcaaugccacagacacaugggugaccuaugggacguguucacaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuucuuagcacaugccauaggaacauccaucacucagaaagggaucauuuucauuuugcuaaugcuggugacaccaucaauggccaugcgaugcgugggaauaggcaacagagacuucguugaaggacugucaggagcaacguggguggacgugguauuggagcauggaagcugcgucaccaccauggcaaaaaacaaaccaaccuuggacauugaacucuugaagacggaggucacgaacccugccgucuugcgcaaacugugcauugaagcuaaaauaucaaacaccaccaccgauucaagauguccaacacaaggagaggccacacugguggaagaacaagacgcgaacuuugugugucgccgaacguuuguggacagaggcugggguaaugguuguggacuauucggaaagggaagccuauugacgugugccaaguucaagugugugacaaaacuagaaggaaagauaguucaauaugaaaacuugaaauauucagugauagucacuguccacacuggggaccagcaccaggugggaaacgagaccacagaacauggaacaauugcaaccauaacaccucaagcuccuacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacacuugaaaugcagacuaaaaauggauaaacugacuuuaaaggggacgucauaugugaugugcacaggcucauuuaagcuagagaaggaaguggcugagacccaacauggaacuguucuagugcaggucaaauacgaaggaacagacgcgccaugcaaaauccccuuuucgacccaagaugagaaaggagugacccagaauggaagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaacugguacaccagguuuuuggaacugcauaugggguucuguucagcgguguuucuuggaccaugaaaauaggaauagggauucugcugacaugguugggauuaaauucaaggagcacgucacuuucaaugacgugcauugcaguuggcaugguuacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuagaccacaacccauggaacacaaauacucauggaaaagcuggggaaaagcuaaaaucauaggagcagacauacaaaauaccaccuucaucaucgacggcccagauaccccagaaugccccgaugaucaaagagcguggaacauuugggaaguugaggacuauggguuuggaauuuucacgacuaacauauggcugaaauugcgugacuccuacacccaaaugugugaccaccgguuaaugucagcugccaucaaggacagcaaggcaguccaugcugacaugggguacuggauagaaagugaaaagaacgaaaccuggaaguuggcgagagccuccuucauagaagucaagacuugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuagucaggucgauggucucugcagggucaggagaaguggacaguuuuucauugggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagccaaugcuucagacaagauggggaugggaacaacguaccuagccuugauggccacuuucaaaaugagaccaauguucgcuguugggauauuguuucgcagacuaacauccagagaaguucuucuucucacgauuggauuaagccugguggcauccguagagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccauuaaccauguuucuuauaacagaaaauaaaaucuggggaaggaaaaguuggcccaucaaugaaggaauuauggcuauuggaauagucagcauucuacugaguucacuccucaaaaaugaugugccguuggccggcccacuaauagcuggaggcaugcuaauagcauguuaugucauauccggaagcucagccgauuuaucauuggagaaagcggcugaggugucuugggaacaagaagcagaacacucagguaccucacacaacauauuaguagagguccaagaugauggaacuaugagaauaaaagaugaagagaaggaugacacacucacuauacuccuuaaagcaacuuugcuggcagucucaggaguguacccaaugucaauaccagcaacucuuuuugugugguauuucuggcagaaaaagaaacagagaucaggaguauuaugggacacacccagcccuccggaaguggaaagagcaguucuugaugauggcaucuauagaaucuugcaaagaggacuguugggcagaucccaagugggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuucugaaggcgaagucggagccauagcucuagauuuuaaacccggcacaucuggaucucccaucgugaacagagagggaaaaauaguaggucuuuauggaaauggaguggugacaacaaguggaaccuacgucagugccauugcucaagcuaaaacaucacaggaagggccucuaccagagauugaggacgagguguucaagaaaagaaacuuaacaauaauggaccugcauccaggaucaggaaaaacaagaagauaucuuccggccauaguccgugaggccauaaaaaagaagcugcgcacguuaaucuuggcucccacaagaguugucgccucugaaauggcagaggcgcucaagggaaugccaauaagauaucagacaacagcagugaagagugaacacacaggaagggagauaguagaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguagaggccuuuccacagaguaaugcaguuauccaagaugaggaaagagacauuccugagagaucauggaacucaggcuacgacuggaucacugauuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaacaaugauugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagcccuugaauaacgaugaggaucacgcucauuggacagaagcaaaaaugcuccuugacaacauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguauuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacacuugacgcugagagcccagaaugcucuggauaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuucuugauggugcugcucauuccagagccagacagacaacgcacuccacaggacaaccagcuagcauauguggugauagguuuguuauucaugauacugacaguggcagccaaugagaugggauuauuggaaaccacaaagagagaccuggggauuggccauguggccgccgaaaaccaccaacaugccacaaugcuggacguagaccuacguccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggacauaggagucccacuucucgccuuagggugcuauucccaggugaacccauugacacugacagcggcaguguugauguuaguggcucauuaugccauaauuggaccaggacugcaagcaaaggccacuagagaagcucaaaaaaggacagcggccggaauaaugaaaaauccaacuguagacgggauuguugcuauagacuuggauccugugguuuaugaugcaaaauuugaaaaacagcuaggccaaauaaugcuacugauacuuuguacaucacaaauucucuugaugcggaccacaugggccuugugugaauccaucacacuggcgacuggaccccugaccacucucugggagggaucuccaggaaaauucuggaauaccacgauagcaguguccauggcaaacaucuucaggggaaguuaucuagcaggagcaggucuggcuuucucauugaugaaaucuuuaggaggagguaggagagguacgggagcucaaggggaaacacugggagagaaauggaaaagacaguuaaaccaacugagcaagccagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaagggaaagucauagaccucgguuguggaagggguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuuuugugugauauuggugaguccucuccgaauccaacuauagaagaaggaagaacguuacguguucuaaaaaugguggaaccauggcucagaggaaaccaauucugcauaaaaauccuaaauccuuauaugccaagugugguagaaacucuggagcaaaugcaaagaaaacauggagggaugcuaguacgaaacccacucucaagaaauuccacccaugaaauguacuggguuucauguggaacaggaaauauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuaugguaaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaaaugguugugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcauagagagagggagcuucauaaacagggaaaaugugccacgugugucuacaacaugauggggaagagagagaaaaaacuaggagaguuuggaaaggcaaagggaagccgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacaucaauuuuuaagcugaccuaucaaaauaagguggugagggugcaaagaccagcaaaaaauggaaccgugauggauguuauaucuagacgugaccagagaggaaguggacaggucggaacuuacggcuuaaauacuuucacuaauauggagguccaacuaauaagacaaauggagucugaaggaaucuuuuuacccagcgaauuggaaacccccaaccuagcugagagaguucuugacugguuggaaaaacauggcgccgaaaggcugaaaagaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuuguaggcagggcuagaguaucacaaggcgccggauggagccugagagaaacugcuugccuaggcaagucauaugcacaaauguggcaguugauguacuuccacaggagagaccugagacuagcggcuaacgcuaucuguucagccgucccaguugauugggucccaaccagccgcacaaccuggucaauucaugcccaccaccaauggaugacaacagaagacauguuaucaguguggaauaggguuuggauagaggaaaacccauggauggaggacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5535 - RNA, 9879 nt, Artificial Sequence
  derived and/or modified CDS sequence (wt) from DENV-1__KF973464__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacgcuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacuaacccagccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcuggggcaauggcuguggacuauucggaaagggaagccuauugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcugguuacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagacugauaacagccaaucccauagucacugacaaagaaaaaccagucaacauugagacugaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacauccgugggaaaauugguacaccagguuuuuggaaccgcauaugggguucuguucagcgguguuucuuggaccaugaaaauaggaauagggauucugcugacauggcugggauuaaauucaaggagcacgucacuuucgaugacgugcaucgcaguuggcaugguuacacuauaccuaggagucaugguucaagcggacucgggaugugugaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaauuauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggauacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuaggcuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucauaucucucuuucccuuaugccuguccacgaccucccaaaaaacaacauggcuuccggugcuguuaggaucuuuuggaugcaaaccguuaaccauguuucuuauaacagaaaacaaaaucuggggaaggaaaaguuggccccuuaaugaaggaaucauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucaccauacuccuuaaagcaacuuugcuggcagugucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugauuucauauggaggagguuggagguuucaaggaucauggaacacgggagaagaagugcaggugauagcuguugaaccaggaaaaaaccccaaaaauguacagacaacaccggguaucuucaagacuccugaaggugaaguuggagccauagcucuagauuuuaaacccggcacaucuggaucuccuaucgugaauagagagggaaaaauaguaggucuuuauggaaauggaguggugacaacaaguggaaccuacguuagugccauugcccaagcuaaagcaucacaggaagggccucuaccagagauugaggacgagguguuuaagaaaagaaacuuaacaauaauggaccugcauccaggaucaggaaaaacaagaagauaucuuccagccaugguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuucaugacagccacucccccaggaucgguggaggcuuuuccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggauuauguugucacaacagacauuuccgaaaugggggcaaauuuccgggccgacaggguaauagacccaaggcggugcuugaaaccgguaauacuaaaagaugguccagagcgugucauucuagccggaccgaugccagugaccguggccagugcugcccagaggagaggaagaauuggaaggaaccaaaauaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaagaaacaaccagguguuggaggagaacauggacguggagaucuggacaaaggaaggagaaagaaagaaacugcgaccccgcugguuggacgccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggaaccccauuggauagcggccuccaucauacuagaguucuuucugauggugcugcuuauuccagagccagacagacagcgcacuccacaggauaaccagcuagcauauguggugauagguuuguuauucaugauacugacaguggcagccaaugagaugggguuauuggaaaccacaaagaaagaccuggggauuggccauguagcugccgaaaaccaucaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguuaauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugauacaaaauuugaaaaacagcuaggccaaauaauguuacugauacuuuguacaucacagauccucuuaaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaucuacaaaaggaguggaauuauggagguggacagauccgaagccaaagagggacugaaaagaggagaaacaaccaaacaugcagugucgagaggaacagccaaauugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuucaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaauauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggagugguaagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucgaacgcagcaauaggagcaguguucguugaugaaaaccaauggaacucagcaaaagaagcaguggaagacgaaagguuuugggaucucgugcacagagagagggagcuucauaaacagggaaaaugugccacgugcgucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggagggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggaaccugaacaugcucuauuggcuacgucaauuuuuaagcugacuuaucaaaacaaaguggugagggugcaaagaccagcaaaaaacggaaccgugauggaugucauaucuagacgugaccagagaggaaguggacaggucggaacuuauggcuuaaauacuuucacuaacauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuagugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacccauguauccagcugggaagaaguuccauaccuagggaaaagggaagaucaaugguguggaucccugauaggcuugacagcgagggccaccugggccacuaacauacaaguggccauaaaccaagugagaagacucaucgggaaugagaauuaucuagauuauaugacaucaaugaagagauucaagaaugagagugaucccgaaggggcacucugguga

SEQ ID NO: 5536 - RNA, 9879 nt, Artificial Sequence
  derived and/or modified CDS sequence (wt) from DENV-1__KF973465__SS-prME
uccgugaccaugcuucucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacgcuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacagaggucacgaacccagccauuuugcgcaaacugugcauugaagcuaaaauaucaaacaccaccaccgauucaagauguccaacacaaggagaggcuacauugguggaagaacaagacgcgaacuuugugugucgccgaacguuuguggacagaggcuggggcaauggcuguggacuauucggaaagggaagccuauugacgugugcuaaguucaagugugugacaaaacuagaaggaaagauaguccaauaugaaaacuuaaaauauucagugauagucacuguccauacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcugguuacauucaagacagcucaugcaaagaaacaggagguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagacugauaacagccaaucccauagucacugacaaagaaaaaccagucaacauugagacugaaccaccuuuuggugagaguuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccaugggaggaguguucacauccgugggaaaauugguacaccagguuuuuggaaccgcauaugggguucuguucagcgguguuucuuggaccaugaaaauaggaauagggauucugcugacauggcugggauuaaauucaaggagcacgucacuuucgaugacgugcaucgcaguuggcaugguuacauuauaccuaggagucaugguucaagcggacucgggaugugugaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuauagaccaggguauuucacacaaacagcagggccauggcaccuaggcaaguuggaauuggauuuugaguugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuaggcuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucauaucucucuuucccuuaugccugucuacgaccucccaaaaaacaacauggcuuccggugcuguuaggaucuuuuggaugcaaaccguuaaccauguuucuuauaacagaaaacaaaaucuggggaaggaaaaguuggccccucaaugaaggaaucauggcuauuggaauaguuagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucaccauacuccuuaaagcaacuuugcuggcagugucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugauuucauauggaggagguuggagguuucaaggaucauggaacacgggagaagaagugcaggugauagcuguugaaccaggaaaaaaccccaaaaauguacagacaacaccggguaccuucaagacuccugaaggugagguuggagccauagcucuagauuuuaaacccggcacgucuggaucuccuaucgugaacagagagggaaaaauagugggucuuuauggaaauggaguggugacaacaaguggaaccuacguuagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuucaugacagccacucccccaggaucgguggaggcuuucccacagagcaaugcaguuauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaccagaaaacaaaaaacaaugacugggauuauguugucacaacagacaucuccgaaaugggggcaaauuuccgggccgacaggguaauagacccaaggcggugcuugaaaccgguaauacuaaaagaugguccagagcgugucauucuagccggaccgaugccagugaccguggccagugcugcccagaggagaggaagaauuggaaggaaccaaaauaaggaaggugaucaguacguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaaggaacaaccagguguuggaggagaacauggacguggagaucuggacaaaggaaggagaaagaaagaaacugcgaccccgcugguuggacgccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcauaauuccgaacaaggaggaaaagccuauagacaugcuauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggaaccccauuggauagcggccuccaucauacuagaguucuuucugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagcugccgaaaaccaucaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugauacaaaauuugaaaaacagcuaggccaaauaauguuacugauacuuuguacgucacagauccucuuaaugcggaccacaugggccuugugugaauccaucacacuagcuacuggaccccuaaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugaguaagucagaauucaacaucuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuucaugccaccugagaaaugugacacccuucugugugauauuggugaguccucuccgaauccaacuauagaagaaggaagaacguuacguguuuuaaaaaugguggaaccauggcuaagaggaaaccaauucugcauaaaaauccuaaauccuuacaugccaagugugguagaaacucuggagcaaaugcaaagaaaauauggagggaugcuagugcgaaacccacucucaagaaauuccacccaugaaauguacuggguuucaugugggacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggagugguaagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucgaacgcagcaauaggagcaguguucguugaugaaaaccaauggaacucagcaaaagaagcaguggaagacgaaagguuuugggaucucgugcgcagagagagggagcuucauaaacagggaaaaugugccacgugcgucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggagggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggagccugaacaugcucuauuggcuacgucaaucuuuaagcugacuuaucaaaacaaaguggugagggugcaaagaccagcaaaaaacggaaccgugauggaugucauauccagacgugaccagagaggaaguggacaggucggaacuuauggcuuaaauacuuucacuaacauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuagugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggagaacccauggauggaggacaaaacccauguauccaguugggaagaaguuccauaccuagggaaaagggaagaucaaugguguggaucccugauaggcuugacagcgagggccaccugggccacuaacauacaaguggccauaaaccaagugagaagacucaucgggaaugagaauuaucuagauuauaugacaucaaugaagagauucaagaaugagagugaucccgaaggggcacucugguga

SEQ ID NO: 5537 - RNA, 9879 nt, Artificial Sequence
  derived and/or modified CDS sequence (wt) from DENV-1__KF973466__SS-prME
uccguaaccaugcuccucaugcugaugcccacagcccuggcguuccauuugaccacacgggggggagagccacacaugauaguuaguaagcaugaaagaggaaaggcacucuuguuuaagaccucuacaggugucaacaugugcacucucauugcgauggacuugggagaguuaugugaggacacaaugaccuacaaauguccccggauuacugaggcggaaccagaugauguugacugcuggugcaaugccacagacacaugggugaccuaugggacguguucacaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuucuuagcacaugccauaggaacauccaucacucagaaagggaucauuuucauuuugcuaaugcuggugacaccaucaauggccaugcgaugcgugggaauaggcaacagagacuucguugaaggacugucaggagcaacguggguggacgugguauuggagcauggaagcugcgucaccaccauggcaaaaaacaaaccaaccuuggacauugaacucuugaagacggaggucacgaacccugccgucuugcgcaaacugugcauugaagcuaaaauaucaaacaccaccaccgauucaagauguccaacacaaggagaggccacacugguggaagaacaagacgcgaacuuugugugucgccgaacguuuguggacagaggcugggguaaugguuguggacuauucggaaagggaagccuauugacgugugccaaguucaagugugugacaaaacuagaaggaaagauaguucaauaugaaaacuugaaauauucagugauagucacuguccacacuggggaccagcaccaggugggaaacgagacuacagaacauggaacaauugcaaccauaacaccucaagcuccuacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacacuugaaaugcagacuaaaaauggauaaacugacuuuaaaggggacgucauaugugaugugcacaggcucauuuaagcuagagaaggaaguggcugagacccaacauggaacuguucuagugcaggucaaauacgaaggaacagacgcgccaugcaaaauccccuuuucgacccaagaugagaaaggagugacccagaauggaagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaacugguacaccagguuuuuggaacugcauaugggguucuguucagcgguguuucuuggaccaugaaaauaggaauagggauucugcugacaugguugggauuaaauucaaggagcacgucacuuucaaugacgugcauugcaguuggcaugguuacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacaguggucguaggagaugcuaauggaauuuuggcccaagggaaaaaaaugauuagaccacaacccauggaacacaaauacucauggaaaagcuggggaaaagcuaaaaucauaggagcagacauacaaaauaccaccuucaucaucgacggcccagauaccccagaaugccccgaugaucaaagagcguggaacauuugggaaguugaggacuauggguuuggaauuuucacgacuaacauauggcugaaauugcgugacuccuacacccaaaugugugaccaccgguuaaugucagcugccaucaaggacagcaaggcaguccaugcugacaugggguacuggauagaaagugaaaagaacgaaaccuggaaguuggcgagagccuccuucauagaagucaagacuugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuagucaggucgauggucucugcagggucaggagaaguggacaguuuuucauugggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagccaaugcuucagacaggauggggaugggaacaacguaccuagccuugauggccacuuucaaaaugagaccaauguucgcuguugggauauuguuucgcagacuaacauccagagaaguucuucuucucacgauuggauuaagccugguggcauccguagagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccauuaaccauguuucuuauaacagaaaauaaaaucuggggaaggaaaaguuggcccaucaaugaaggaauuauggcuauuggaauagucagcauucuacugaguucacuccucaaaaaugaugugccguuggccggcccacuaauagcuggaggcaugcuaauagcauguuaugucauauccggaagcucagccgauuuaucauuggagaaagcggcugaggugucuugggaacaagaagcagaacacucagguaccucacacaacauauuaguagagguccaagaugauggaacuaugagaauaaaagaugaagagaaggaugacacacucacuauacuccuuaaagcaacuuugcuggcagucucaggaguguacccaaugucaauaccagcaacucuuuuugugugguauuucuggcagaaaaagaaacagagaucaggaguauuaugggacacacccagcccuccggaaguggaaagagcaguucuugaugauggcaucuauagaaucuugcaaagaggacuguugggcagaucccaagugggagugggagucuuccaagacggcguguuccacacaauguggcacgucaccaggggagcuguccuuauguaccaagggaagaggcuggaaccaagcugggccaguguaaaaaaggacuugaucucauauggaggagguuggagguuucaaggaucauggaacacgggagaagaagugcaggugauagcuguugaaccaggaaaaaaccccaaaaauguacagacaacgccggguaccuucaagacuucugaaggcgaagucggagccauagcucuagauuuuaaacccggcacaucuggaucucccaucgugaacagagagggaaaaauaguaggucuuuauggaaauggaguggugacaacaaguggaaccuacgucagugccauugcucaagcuaaaacaucacaggaagggccucuaccagagauugaggacgagguguucaagaaaagaaacuuaacaauaauggaccugcauccaggaucaggaaaaacaagaagauaucuuccggccauaguccgugaggcuauaaaaaggaagcugcgcacguuaaucuuggcucccacaagaguugucgccucugaaauggcagaggcgcucaagggaaugccaauaagauaucagacaacagcagugaagagugaacacacaggaagggagauaguagaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguagaggccuuuccacagaguaaugcaguuauccaagaugaggaaagagacauuccugagagaucauggaacucaggcuacgacuggaucacugauuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaacaaugauugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagcccuugaauaacgaugaggaucacgcucauuggacagaagcaaaaaugcuccuugacaacauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguauuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacacuugacgcugagagcccagaaugcucuggauaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuucuugauggugcugcucauuccagagccagacagacaacgcacuccacaggacaaccagcuagcauauguggugauagguuuguuauucaugauacugacaguggcagccaaugagaugggauuauuggaaaccacaaagagagaccuggggauuggccauguggccgccgaaaaccaccaacaugccacaaugcuggacguagaccuacguccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggacauaggagucccacuucucgccuuagggugcuauucccaggugaacccauugacacugacagcggcaguguugauguuaguggcucauuaugccauaauuggaccaggacugcaagcaaaggccacuagagaagcucaaaaaaggacagcggccggaauaaugaaaaauccaacuguagacgggauuguugcuauagacuuggauccugugguuuaugaugcaaaauuugaaaaacagcuaggccaaauaaugcuacugauacuuuguacaucacaaauucucuugaugcggaccacaugggccuugugugaauccaucacacuggcgacuggaccccugaccacucucugggagggaucuccaggaaaauucuggaauaccacgauagcaguguccauggcaaacaucuucaggggaaguuaucuagcaggagcaggucuggcuuucucauugaugaaaucuuuaggaggagguaggagagguacgggagcucaaggggaaacacugggagagaaauggaaaagacaguuaaaccaacugagcaagccagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaagggaaagucauagaccucgguuguggaagggguggcuggucauauuauugugcugggcugaagaaagucacugaagugaagggauacacaaaaggaggaccuggacaugaggaaccuaucccaauggcgaccuauggauggaaccuaguaaagcuacacucugggaaagauguauuuuuuaugccaccugagaaaugugacacccuuuugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuaguacgaaacccacucucaagaaauuccacccaugaaauguacuggguuucauguggaacaggaaauauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuaugguaaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaaaugguugugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcauagagagagggagcuucauaaacagggaaaaugugccacgugugucuacaacaugauggggaagagagagaaaaaacuaggagaguuuggaaaggcaaagggaagccgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacaucaauuuuuaagcugaccuaucaaaauaagguggugagggugcaaagaccagcaaaaaauggaaccgugauggauguuauaucuagacgugaccagagaggaaguggacaggucggaacuuacggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuuguaggcagggcuagaguaucacaaggcgccggauggagccugagagaaacugcuugccuaggcaagucauaugcacaaauguggcaguugauguacuuccacaggagagaccugagacuagcggcuaacgcuaucuguucagccgucccaguugauugggucccaaccagccgcacaaccuggucaauucaugcccaccaccaauggaugacaacagaagacauguuaucaguguggaauagggucuggauagaggaaaacccauggauggaggacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucauugggaaugagaauuaucuagauuacaugacaucaaugaagagauucaagaaugagagugaucccgaaggggcacucugguaa

SEQ ID NO: 5538 - RNA, 9879 nt, Artificial Sequence
  derived and/or modified CDS sequence (wt) from DENV-1__KF973471__SS-prME
uccgugaccaugcuucucaugcugcugcccacagcccuggcguuccauuugaccacacgagggggagagccacacaugauaguuaguaagcaggaaagaggaaagucacucuuguuuaaaaccucugcaggugucaauaugugcacucucauugcgauggacuugggagaguuaugugaggacacaaugaccuacaaaugcccccagaucacugaggcggaaccagaugacguugacugcuggugcaaugccacagacacaugggugaccuaugggacguguucucaaaccggcgaacaccgacgagacaaacgcuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaaccuuggacauugaacucuugaagacggaggucacuaacccagccaucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcuggggcaauggcuguggacuauucggaaagggaagccuauugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcgaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcugguuacauucaagacagcucaugcaaagaaacaggaaguagucguacugggaucacaggaaggagcaaugcacacugcguugacuggggcgacagaaauccagacgucaggaacgacaacaaucuuugcaggacaucugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagacugauaacagccaaucccauagucacugacaaagaaaaaccagucaacauugagacugaaccaccuuuuggugagagcuacaucgugguaggggcaggugaaaaagcuuuaaaacuaagcugguucaagaaaggaagcagcauagggaaaauguucgaagcaaccgcccgaggagcacgaaggauggcuauucugggagacaccgcaugggacuuuggcuccauaggaggaguguucacauccgugggaaaauugguacaccagguuuuuggaaccgcauaugggguucuguucagcgguguuucuuggaccaugaaaauaggaauagggauucugcugacauggcugggauuaaauucaaggagcacgucacuuucgaugacgugcaucgcaguuggcaugguuacacuauaccuaggagucaugguucaagcggacucgggaugugugaucaacuggaagggcagagaacucaaauguggaaguggcauuuuugucacuaaugaaguccacacuuggacagagcaauacaaauuccaggcugacuccccaaaacgacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgauaaccaaagagcguggaacauuugggaaguugaggacuaugguuuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacaccggcuguuuuccuccuucuuauaaugggacaacugacauggaaugaucugauuaggcuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuagaggagcuaggggauggacuugcaauggguaucaugauguuaaaauuauugacugaauuucagccacaccaguuauggaccaccuuacugucucugacauucaucaaaacaacucuuucauuggauuaugcauggaaaacaacggcuauggcacugucaaucauaucucucuuucccuuaugccuguccacgaccucccaaaaaacaacauggcuuccggugcuguuaggaucuuuuggaugcaaaccguuaaccauguuucuuauaacagaaaacaaaaucuggggaagaaaaaguuggccccuuaaugaaggaaucauggcuaucggaauaguuagcauucuacuaaguucacuccucaaaaaugaugugccguuggccggcccacuaacagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucaccauacuccuuaaagcaacuuugcuggcagugucaggaguguacccaaugucaauaccagcaacucuuuuugugugguacuuuuggcagaaaaagaaacagagaucaggaguguuaugggacacacccaguccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggauuugauuucauauggaggagguuggagguuucaaggaucauggaacacgggagaagaagugcaggugauagcuguugaaccaggaaaaaaccccaaaaauguacagacaacaccggguaccuucaagacuccugaaggugaaguuggagccauagcucuagauuuuaaacccggcacaucuggaucuccuaucgugaauagagagggaaaaauaguaggucuuuauggaaauggaguggugacaacaaguggaaccuacguuagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuucaugacagccacucccccaggaucgguggaggcuuuuccacagagcaaugcagucauccaagaugaggaaagagacauuccugagagaucauggaacucaggcuacgacuggaucacugauuuuccagguaaaacagucugguuugucccaaguauuaaaucaggaaaugacauugcuaacuguuuaagaaagaacggaaaacggguaauccaauugagcagaaaaaccuuugacacugaguaucagaaaacaaaaaacaaugacugggauuauguugucacaacagacauuuccgaaaugggggcaaauuuccgggccgacaggguaauagacccaaggcggugcuugaaaccgguaauacuaaaagaugguccagagcgugucauucuagccggaccgaugccagugaccguggccagugcugcccagaggagaggaagaauuggaaggaaccaaaauaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuauaaaguagccucagaagguuuccaguacuccgacagaagguggugcuuugauggggaaagaaacaaccagguguuggaggagaacauggacguggagaucuggacaaaggaaggagaaagaaagaaacugcgaccccgcugguuggacgccagaacauacucugauccauuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuguggauggccaguguggaaccccauuggauagcggccuccaucauacuagaguucuuucugauggugcugcuuauuccagagccagacagacagcgcacuccacaggauaaccagcuagcauauguggugauagguuuguuauucaugauacugacaguggcagccaaugagaugggguuauuggaaaccacaaagaaagaccuggggauuggccauguagcugccgaaaaccaucaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugauacaaaauuugaaaaacagcuaggccaaauaauguuacugauacuuuguacaucacagauccucuuaaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaucuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuucaugccaccugagaaaugugacacccuucugugugauauuggugaguccucuccgaauccaacuguagaagaaggaagaacguuacguguuuuaaaaaugguggaaccauggcuaaaaggaaaccaauucugcauaaaaauccuaaauccuuacaugccaagugugguagaaacucuggagcaaaugcaaagaaaauauggagggaugcuagugcgaaacccacucucaagaaacuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcacuaugaugaggacaauccauacaaaacaugggccuaucauggaucauaugaggucaagccaucaggaucagccucaucuauggugaauggagugguaagauugcucacaaaaccaugggauguuauccccauggucacacaaauagcuaugaccgauaccacacccuuuggacaacagagaguguuuaaagagaaaguugauacgcgcacaccaagagcaaaacgaggcacaacacaaauuauggaggugacagccaagugguuaugggguuuccuuuccagaaacaaaaaacccagaaucugcacaagagaggaguucacaagaaagguuaggucgaacgcagcaauaggagcaguguucguugaugaaaaccaauggaacucagcaaaagaagcaguggaagacgaaagguuuugggaucucgugcacagagagagggagcuucauaaacagggaaaaugugccacgugcgucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggagggagaaggacugcacaaacuuggauacauacucagagacauaucaaagauuccggggggaaauauguaugcagaugauacagccgguugggacacaagaauaacagaggaugaucuucagaaugaggcuaaaaucacugacaucauggaaccugaacacgcucuauuggcuacgucaauuuuuaagcugacuuaucaaaacaaaguggugagggugcaaagaccagcaaaaaacggaaccgugauggaugucauauccagacgugaccagagaggaaguggacaggucggaacuuauggcuuaaauacuuucacuaacauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcuacagccuuaacagcccugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuagugggcagggcuagaguaucacaaggcgccggauggagccugagagaaacugcuugccuaggcaagucauaugcacaaauguggcagcugauguacuuccauaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacccauguauccaguugggaagaaguuccauaccuagggaaaagggaagaucaaugguguggaucccugauaggcuugacagcgagggccaccugggccacuaacauacaaguggccauaaaccaagugagaagacucaucgggaaugagaauuaucuagauuauaugacaucaaugaagagauucaagaaugagagugaucccgaaggggcacucugguga

SEQ ID NO: 5539 - RNA, 9879 nt, Artificial Sequence
  derived and/or modified CDS sequence (wt) from DENV-1__KF973472__SS-prME
uccgugaccaugcuccucaugcugcugcccacagcccuggcguuccaucugaccacacgggggggagagccacacaugauaguuaguaagcaugaaagaggaaagucacucuuguuuaagaccucuacaggugucaacaugugcacucucaucgcgauggaccugggagaguuaugugaggacacaaugaccuacaaauguccccggauuacugaggcggaaccagaugacguugacugcuggugcaaugccacagacacaugggugaccuaugggacguguucucaaaccggcgaacaccgacgagauaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcuaaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacccuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacgcuuguggacagaggcugggguaaugguugcggacuauucggaaagggaagccuauugacgugugccaaguucaagugugugacaaaacuagaaggaaagauaguucaauaugaaaacuugaaauauucagugauagucacuguccacacuggggaccagcaccaggugggaaacgagacuacagaacauggaacaauugcaaccauaacaccucaagcucccacgucggaaauacagcugacugacuacggagcccucgcauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucgugcugggaucacaggaaggagcaaugcacacugcguugacuggggcgacagaaauccagacgucaggaacgacaacaauuuuugcaggacacuugaaaugcagacuaaaaauggauaaauugacuuuaaaggggacaucauaugugaugugcacaggcucauuuaagcuagagaaggaaguggcugagacccaacauggaacuguucuagugcaggucaaauacgaaggaacagacgcgccaugcaagauccccuuuucgacccaagaugagaaaggagugacccagaauggaagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaacugcccgaggagcacgaaggauggcuauccugggagacaccgcaugggacuucggcucuauaggaggaguguucacaucuguaggaaaauugguacaccagguuuuuggaaccgcauaugggguucuguucagcgguguuucuuggaccaugaaaauaggaauagggauucugcugacaugguugggauuaaauucaaggagcacgucacuuucagugacgugcauugcaguuggcaugguuacacuguaccuaggagucaugguucaagcggacucgggauguguaaucaacuggaagggcagagaacuuaaauguggaaguggcauuuuugucacuaaugaaguccacacuuggacagagcaauacaaauuccaggcugauuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgaugaccaaagagcguggaacauuugggaaguugaggacuauggguuuggaauuuucacgacuaacauauggcuaaaauugcgugacuccuacacccaaaugugugaccaccggcuaaugucagcugccaucaaggacagcaaggcaguccaugcugacaugggguacuggauagaaagugaaaagaacgaaaccuggaaguuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacacuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucgauggucucugcagggucaggagaaguggacaguuuuucauugggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaauugagaccaauguucgcuguugggauauuguuucgcagacuaacauccagagaaguucuucuccucacgauuggauuaagccugguggcauccguagagcuaccaaauucuuuggaggagcuaggggauggacuugcaauggguaucaugauguuaaaauuauugacugaauuucagccacaccaguuauggaccaccuuacugucucugacauuuaucagaacaacucuuucacuggauuaugcauggaaaacaacggcuauggcacugucaaucgugucucucuuuccuuuaugccugucuacgaccucccaaaaaacaacauggcuuccggugcuguuaggaucuuuuggaugcaaaccauuaaccauguauuuuauaacagaaaacaaaaucuggggaaggaaaaguuggcccaucaaugaaggaaucauggcuauuggaauagucagcauucuacugaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacucagguaccucacacaacauauuaguagagguccgagaugauggaacuaugagaauaaaagaugaagagaaggaugacacacucacuauacuccuuaaagcaacuuugcuagcagucucaggaguguacccaaugucaauaccagcaacucuuuuugugugguauuucuggcagaaaaagaaacagagaucaggaguguuaugggacacacccagcccuccggaaguggaaagagcaguucuugaugauggcaucuauagaaucuugcaaagaggacuguugggcagaucccaagugggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaagucggagccauagcucuagauuuuaaacccggcacaucuggaucucccauugugaacagagagggaaaaauaguaggucuuuauggaaauggaguggugacaacaaguggaaccuaugucagugccauugcucaagcuaaagcaucacaggaagggccucuaccagagauugaggacgagguguucaagaaaagaaacuuaacaauaauggaccugcauccaggaucaggaaaaacaagaagauaucuuccggccauaguccgugaggccauaaaaaggaagcugcgcacguuaaucuuggcucccacaagaguugucgccucugaaauggcagaggcgcucaagggaaugccaauaagauaucagacaacagcagugaagagugaacacacaggaagggagauaguagaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguagaggccuuuccacagaguaaugcaguuauccaagaugaggaaagagacauuccugagagaucauggaacucaggcuacgacuggaucacugauuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaacaaugauugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagccuuugaauaacgaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguauuccgacagaagguggugcuuugauggggaaaggaacaaccagguguuggaggagaacauggacguagagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacacuugacgcugagagcccagaaugcucuggauaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuucuugauggugcugcucauuccagagccagacagacagcgcacuccacaggacaaccagcuagcauauguggugauagguuuguuauucaugauacugacaguggcagccaaugagaugggauuauuggaaaccacaaagagagaccuggggauuggccauguggccgccgaaaaccaccaacaugccacgaugcuggacguagaccuacguccagccucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggagucccacuucucgccuuagggugcuauucccaggugaacccauugacacugacagcggcaguguugauguuaguggcucauuaugccauaauuggaccaggacugcaagcaaaggccacuagagaagcucaaaaaaggacagcggccggaauaaugaaaaauccaacuguagacgggauuguugcuauagacuuggauccugugguuuaugaugcaaaauuugaaaaacagcuaggccaaauaaugcuacugauacuuuguacaucacaaauucuuuugaugcggaccacaugggccuugugugaauccaucacacuggcgacuggacccuugaccacucucugggagggaucuccaggaaaauucuggaauaccacgauagcagugucuauggcaaacaucuucaggggaaguuaucuagcaggagcaggucuggcuuucucauugaugaaaucuuuaggaggagguaggagagguacgggagcucaaggggaaacacugggagagaaauggaaaagacaguuaaaccaacugagcaagccagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaagggaaagucauagaccucgguuguggaagggguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuuuugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuaguacgaaacccacucucaagaaauuccacccaugaaauguacuggguuucauguggaacaggaaauauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuaugguaaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguugugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcauagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacaucaauuuuuaagcugaccuaucaaaauaagguggugagggugcaaagaccagcaaaaaauggaaccgugauggauguuauaucuagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccaguugaucaugaaggaugggagggaaauaguggugccaugccgcaaccaagaugaacuuguaggcagggcuagaguaucacaaggcgccggauggagccugagagaaacugcuugccuaggcaagucauaugcacaaauguggcaguugauguacuuccacaggagagaccugagacuagcggcuaacgcuaucuguucagccgucccaguugauugggucccaaccagccgcacaaccuggucaauucaugcccaccaccaauggaugacaacagaagacauguuaucaguguggaauaggguuuggauagaggaaaacccauggauggaggacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaguuaucuagauuacaugacaucaaugaagagguucaagaaugagagugaucccgaaggggcacucugguaa

SEQ ID NO: 5540 - RNA, 9879 nt, Artificial Sequence
  derived and/or modified CDS sequence (wt) from DENV-1__KF973474__SS-prME
uccgugaccaugcuccucaugcugcugcccacagcccuggcguuccauuugaccacacgggggggagagccacacaugauaguuaguaagcaugaaagaggaaagucacucuuguuuaagaccucuacaggugucaacaugugcacucucauugcgauggaccugggagaguuaugugaggacacaaugaccuacaaauguccccggauuacugaggcggaaccagaugacguugacugcuggugcaaugccacagacacaugggugaccuaugggacguguucucaaaccggcgaacaccgacgagauaaacguuccguggcacuggccccacacgugggacuuggucuagaaacaagaaccgaaacauggauguccucugaaggcgccuggaaacaaauacaaagaguggagacuugggcauugagacacccaggauucacggugauagcccuuuuuuuagcacaugccauaggaacauccaucacucagaaagggaucauuuucauuuugcuaaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaaccuuggacauugaacucuugaagacggaagucacgaacccugccgucuugcgcaaacugugcauugaagcuaaaauaucaaacaccaccaccgauucaagauguccaacacaaggagaggcuacacugguggaagaacaagacgcgaacuuugugugucgccgaacgcuuguggacagaggcugggguaaugguugcggacuauucggaaagggaagccuauugacgugugccaaguucaagugugugacaaaacuagaaggaaagauaguucaauaugaaaacuugaaauauucagugauagucacuguccacacuggggaccagcaccagguaggaaacgagacuacagaacauggaacaauugcaaccauaacaccucaagcucccacgucggaaauacagcugacugacuacggagcccucgcauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaauuuuugcaggacacuugaaaugcagacuaaaaauggauaaauugacuuuaaaagggacaucauaugugaugugcacaggcucauuuaagcuagagaaggaaguggcugagacccaacauggaacuguucuagugcaggucaaauacgaaggaacagacgcgccaugcaagauccccuuuucgacccaagaugagaaaggaguaacccagaauggaagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaacugcccgaggagcacgaaggauggcuauccugggagacaccgcaugggacuucggcucuauaggaggaguguucacaucuguaggaaaauugguacaccagguuuuuggaaccgcauaugggguucuguucagcgguguuucuuggaccaugaaaauaggaauagggauucugcugacaugguugggauuaaauucaaggagcacgucacuuucaaugacgugcauugcaguuggcaugguuacacuguaccuaggagucaugguucaagcggacucgggauguguaaucaacuggaagggcagagaacuuaaauguggaaguggcauuuuugucacuaaugaaguccacacuuggacagagcaauacaaauuccaggcugauuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgaugaccaaagagcguggaacauuugggaaguugaggacuauggguuuggaauuuucacgacuaacauauggcuaaaauugcgugacuccuacacccaaaugugugaccaucggcuaaugucagcugccaucaaggacagcaaggcaguccaugcugacaugggguacuggauagaaagugaaaagaacgaaaccuggaaguuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggaugcugguauggcauggaaaucagaccaguaaaggagaaggaggagaaucuaguuaggucgauggucucugcagggucaggagaaguggacaguuuuucauugggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcaaaugcuucagacaggauggggaugggaacaacguaccuagccuugauggcuacuuucaaauugagaccaauguucgcuguugggauauuguuucgcagacuaacauccagagaaguucuucuucucacgauuggauuaagccugguggcauccguagagcuaccaaauucuuuggaggagcuaggggauggacuugcaauggguaucaugauguuaaaauuauugacugaauuucagccacaccaguuauggaccacuuuacugucucugacauuuaucaaaacaacucuuucacuggauuaugcauggaaaacaacggcuauggcacugucaaucgugucucucuuuccuuuaugccugucuacgaccucccaaaaaacaacauggcuuccggugcuguuaggaucuuuuggaugcaaaccauuaaccauguaucuuauaacagaaaacaaaaucuggggaaggaaaaguuggcccaucaaugaaggaauuauggcuauuggaauagucagcauucuacugaguucacuccucaaaaaugaugugccguuggcuggcccacuaauagcuggaggcaugcuaauagcauguuaugucauauccggaagcucagccgauuuaucauuggagaaagcggcugagguguccugggaacaagaagcagaacacucagguaccucacacaacauauuaguagagguccaagaugauggaacuaugagaauaaaagaugaagagaaggaugacacacucacuauacuccuuaaagcaacuuugcuagcagucucaggaguguacccaaugucaauaccagcaacucuuuuugugugguauuucuggcagaaaaagaaacagagaucaggaguguuaugggacacacccagcccuccggaaguggaaagagcaguucuugaugauggcaucuauagaaucuugcaaagaggacuguugggcagaucccaagugggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaagucggagccauagcucuagauuuuaaacccggcacaucuggaucucccauugugaacagagagggaaaaauaguaggucuuuauggaaauggaguggugacaacaaguggaaccuacgucagugccauugcucaagcuaaagcaucacaggaagggccucuaccagagauugaggacgagguguucaagaaaagaaacuuaacaauaauggaccugcauccaggaucagggaaaacaagaagauaucuuccggccauaguccgugaggccauaaaaaggaagcugcguacguuaaucuuggcucccacaagaguugucgccucugaaauggcagaggcgcucaagggaaugccaguaagauaucagacaacagcagugaagagugaacacacaggaagggagauaguagaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguagaggccuuuccacagaguaaugcaguuauccaagaugaggaaagagacauuccugagagaucauggaacucaggcuacgacuggaucacugauuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaacaaugauugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagccuuugaauaacgaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguauuccgacagaagguggugcuuugauggggaaaggaacaaccagguguuggaggagaacauggacguagagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacacuugacgcugagagcccagaaugcucuggauaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuucuugauggugcugcucauuccagagccagacagacagcgcacuccacaggacaaccagcuagcauauguggugauagguuuguuauucaugauacugacaguggcagccaaugagaugggauuauuggaaaccacaaagagagaccuggggauuggccauguggccgcagaaaaccaccaacaugccacgaugcuggacguagaccuacguccagccucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggagucccacuucucgccuuagggugcuauucccaggugaacccauugacacugacagcggcaguguugauguuaguggcucauuaugccauaauuggaccaggacugcaagcaaaggccacuagagaagcucaaaaaaggacagcggccggaauaaugaaaaauccaacuguagacgggauuguugcuauagacuuggauccugugguuuaugaugcaaaauuugaaaaacagcuaggccaaauaaugcuacugauacuuuguacaucacaaauucucuugaugcggaccacaugggccuugugugaauccaucacacuggcgacuggaccuuugaccacucucugggagggaucuccaggaaaauucuggaauaccacgauagcagugucuauggcaaacaucuucaggggaaguuaucuagcaggagcaggucuggcuuucucauugaugaaaucuuuaggaggagguaggagagguacgggagcucaaggggaaacacugggagagaaauggaaaagacaguuaaaccaacugagcaagccagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaagggaaagucauagaccucgguuguggaagggguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuuuugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaauauugugucggcagugaacaugacauccagaauguuacugaaucgauucacaauggcucacaggaagccaacauaugaaagagacguggacuuaggcgcuggaacaagacaugugacaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuaugguaaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguugugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcauagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaguucgaggcccuugguuucaugaaugaagaucacugguuuagcagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacaucaauuuuuaagcugaccuaucaaaauaagguggugagggugcaaagaccagcaaaaaauggaaccgugauggauguuauaucuagacgugaccagagaggaaguggacaggucggaacuuauggcuuaaacacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcuaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccaguugaucaugaaggaugggagggaaauaguggugccaugccgcaaccaagaugaacuuguaggcagggcuagaguaucacaaggcgccggauggagccugagagaaacugcuugccuaggcaagucauaugcacaaauguggcaguugauguacuuccacaggagagaccugagacuagcggcuaacgcuaucuguucagccgucccaguugauugggucccaaccagccgcacaaccuggucaauucaugcccaccaccaauggaugacaacagaagacauguuaucaguguggaauaggguuuggauagaggaaaacccauggauggaggacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5541 - RNA, 9879 nt, Artificial Sequence
  derived and/or modified CDS sequence (wt) from DENV-1__KF973475__SS-prME
uccguaaccaugcuccucaugcugaugcccacagcccuggcguuccauuugaccacacgggggggagagccacacaugauaguuaguaagcaugaaagaggaaaggcacucuuguuuaagaccucuacaggugucaacaugugcacucucauugcgauggacuugggagaguuaugugaggacacaaugaccuacaaauguccccggauuacugaggcggaaccagaugauguugacugcuggugcaaugccacagacacaugggugaccuaugggacguguucacaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuucuuagcacaugccauaggaacauccaucacucagaaagggaucauuuucauuuugcuaaugcuggugacaccaucaauggccaugcgaugcgugggaauaggcaacagagacuucguugaaggacugucaggagcaacguggguggacgugguauuggagcauggaagcugcgucaccaccauggcaaaaaacaaaccaaccuuggacauugaacucuugaagacggaggucacgaacccugccgucuugcgcaaacugugcauugaagcuaaaauaucaaacaccaccaccgauucaagauguccaacacaaggagaggccacacugguggaagaacaagacgcgaacuuugugugucgccgaacguuuguggacagaggcugggguaaugguuguggacuauucggaaagggaagccuauugacgugugccaaguucaagugugugacaaaacuagaaggaaagauaguucaauaugaaaacuugaaauauucagugauagucacuguccacacuggggaccagcaccaggugggaaacgagacuacagaacauggaacaauugcaaccauaacaccucaagcuccuacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaauuuuugcaggacacuugaaaugcagacuaaaaauggacaaacugacuuuaaaggggacgucauaugugaugugcacaggcucauuuaagcuagagaaggaaguggcugagacccaacauggaacuguucuagugcaggucaaauacgaaggaacagacgcgccaugcaaaauccccuuuucgacccaagaugagaaaggagugacccagaauggaagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaacugguacaccagguuuuuggaacugcauaugggguucuguucagcgguguuucuuggaccaugaaaauaggaauagggauucugcugacaugguugggauuaaauucaaggagcacgucacuuucaaugacgugcauugcaguuggcaugguuacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaauggcaugaaauucacagugguuguaggagaugcuaauggaauuuuggcccaagggaaaaaaaugauuagaccacaacccauggaacacaaauacucauggaaaagcuggggaaaagcuaaaaucauaggagcagacauacaaaauaccaccuucaucaucgacggcccagauaccccagaaugccccgaugaucaaagagcguggaacauuugggaaguugaggacuauggguuuggaauuuucacgacuaacauauggcugaaacugcgugacuccuacacccaaaugugugaccaccgguuaaugucagcugccaucaaggacagcaaggcaguccaugcugacaugggguacuggauagaaagugaaaagaacgaaaccuggaaguuggcgagagccuccuucauagaagucaagacuugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuagucaggucgauggucucugcagggucaggagaaguggacaguuuuucauugggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagccaaugcuucagacaggauggggaugggaacaacguaccuagccuugauggccacuuucaaaaugagaccaauguucgcuguugggauauuguuucgcagacuaacauccagagaaguucuucuucucacgauuggauuaagccugguggcauccguagagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccauuaaccauguuucuuauaacagaaaauaaaaucuggggaaggaaaaguuggcccaucaaugaaggaauuauggcuauuggaauagucagcauucuacugaguucacuccucaaaaaugaugugccguuggccggcccacuaauagcuggaggcaugcuaauagcauguuaugucauauccggaagcucagccgauuuaucauuggagaaagcggcugaggugucuugggaacaagaagcagaacacucagguaccucacacaacauauuaguagagguccaagaugauggaacuaugagaauaaaagaugaagagaaggaugacacacucacuauacuccuuaaagcaacuuugcuggcagucucaggaguguacccaaugucaauaccagcaacucuuuuugugugguauuucuggcagaaaaagaaacagagaucaggaguauuaugggacacacccagcccuccggaaguggaaagagcaguucuugaugauggcaucuauagaaucuugcaaagaggacuguugggcagaucccaagugggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuucugaaggcgaagucggagccauagcucuagauuuuaaacccggcacaucuggaucucccaucgugaacagagagggaaaaauaguaggucuuuauggaaauggaguggugacaacaaguggaaccuacgucagugccauugcucaagcuaaaacaucacaggaagggccucuaccagagauugaggacgagguguucaagaaaagaaacuuaacaauaauggaccugcauccaggaucaggaaaaacaagaagauaucuuccggccauaguccgugaggccauaaaaaggaagcugcgcacguuaaucuuggcucccacaagaguugucgccucugaaauggcagaggcgcucaagggaaugccaauaagauaucagacaacagcagugaagagugaacacacaggaagggagauaguagaccuuaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguagaggccuuuccacagaguaaugcaguuauccaagaugaggaaagagacauuccugagagaucauggaacucaggcuacgacuggaucacugauuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaacaaugauugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggcuagugcugcccagaggagaggaagaauuggaaggaaccaaaacaaggaaggugaucaguauguuuacaugggacagcccuugaauaacgaugaggaucacgcucauuggacagaagcaaaaaugcuccuugacaacauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguauuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacacuugacgcugagagcccagaaugcucuggauaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuucuugauggugcugcucauuccagagccagacagacaacgcacuccacaggacaaccagcuagcauacguggugauagguuuguuauucaugauacugacaguggcagccaaugagaugggauuauuggaaaccacaaagagagaccuggggauuggccauguggccgccgaaaaccaccaacaugccacaaugcuggacguagaccuacguccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggacauaggagucccacuucucgccuuagggugcuauucccaggugaacccauugacacugacagcggcaguguugauguuaguggcucauuaugccauaauuggaccaggacugcaagcaaaggccacuagagaagcucaaaaaaggacagcggccggaauaaugaaaaauccaacuguagacgggauuguugcuauagacuuggauccugugguuuaugaugcaaaauuugaaaaacagcuaggccaaauaaugcuacugauacuuuguacaucacaaauucucuugaugcggaccacaugggccuugugugaauccaucacacuggcgacuggaccccugaccacucucugggagggaucuccaggaaaauucuggaauaccacgauagcaguguccauggcaaacaucuucaggggaaguuaucuagcaggagcaggucuggcuuucucauugaugaaaucuuuaggaggagguaggagagguacgggagcucaaggggaaacacugggagagaaauggaaaagacaguuaaaccaacugagcaagccagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaagggaaagucauagaccucgguuguggaagggguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuuuugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuaguacgaaacccacucucaagaaauuccacccaugaaauguacuggguuucauguggaacaggaaauauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuaugguaaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaaaugguugugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcauagagagagggagcuucauaaacagggaaaaugugccacgugugucuacaacaugauggggaagagagagaaaaaacuaggagaguuuggaaaggcaaagggaagccgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacaucaauuuuuaagcugaccuaucaaaauaagguggugagggugcaaagaccagcaaaaaauggaaccgugauggauguuauaucuagacgugaccagagaggaaguggacaggucggaacuuacggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuuguaggcagggcuagaguaucacaaggcgccggauggagccugagagaaacugcuugccuaggcaagucauaugcacaaauguggcaguugauguacuuccacaggagagaccugagacuagcggcuaacgcuaucuguucagccgucccaguugauugggucccaaccagccgcacaaccuggucaauucaugcccaccaccaauggaugacaacagaagacauguuaucaguguggaauaggguuuggauagaggaaaacccauggauggaggacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5542 - RNA, 9879 nt, Artificial Sequence
  derived and/or modified CDS sequence (wt) from DENV-1__FJ898448__SS-prME
ucugugaccaugcuccucaugcugcugcccacaguccugacguuccauuugaccacccgagggggagagccucacaugauaguuagcaaacaggaaagaggaaagucacuuuuguuuaagaccucugcaggugucaacaugugcacccuuauugcaauggaccugggagaguuaugugaugacacgaugaccuacaaauguccccggaucacugagacggaaccagaugacguugacuguuggugcaaugccacggagacaugggugaccuauggaacauguucucaaacuggugaacaccgacgagacaaacguuccguugcacuggcaccacacguagggcuuggucuagaaacaagaaccgaaacguggauguccucugaaggcgcuuggagacaaauacaaaaaguggagacaugggcucugagacacccaggauuuacggugauagcccuuuuucuagcacaugccauaggaacauccaucacccagaaagggauuauuuucauuuugcugaugcuggugacuccauccauggccaugcggugcgugggaauaggaaacagagacuucguggaaggacugucaggagcuacguggguggauguaguucuggagcauggaaguugcgucacuaccauggcaaaagacaaaccaacacuggacauugaacuccugaagacggaggucacaaacccugccguccugcgcaaacuguguauagaagcuaaaauaucaaauaccaccacugacucgagauguccgacacaaggagaagccacgcugguggaagaacaagacacgaacuuugugugucgacgaacauucguggacagaggcuggggcaaugguuguggacuauucggaaaggguagcuuaauaacgugugcuaaguuuaagugugugacaaaauuggaaggaaagauaguccaauaugaaaacuuaaaauauucugugaucguuaccguccacacuggagaccagcaccaaguuggaaaugagaccacagaacauggaacaauugcaaccauaacaccucaagcucccacgucggaaauacaacugacagacuacggagcucuaacacuggauuguucaccuagaacagggcuagacuuuaaugagaugguguugcugacaaugaaagaaaaaucauggcucguccacaaacaaugguuucuagacuuaccacugccuuggaccucaggggccucaacgucccaagagacuuggaacagacaagacuugcuggucacguuuaagacagcucaugcaaagaagcaggaaguagucguacuaggaucacaagaaggagcaaugcacacugcguugacuggagcgacagaaauccaaacgucuggaacgacaacaauuuuugcaggccaccugaaaugcagauuaaaaauggacaaacuaacucuaaaaggaauaucauauguaaugugcacaggcucauucaaguuagagaaggaaguggcugagacccagcauggaacuguucuaguacaggucaaauacgaaggaacagaugcaccaugcaagauccccuucucgucccaagaugagaagggaguaacccagaaugggagauugguaacagccaaccccauagucacugacaaagaaaaaccagucaacauugaagcggagccacccuuuggugagagcuacaucgugguaggagcaggugaaaaagcuuugaaacuaagcugguucaagaagggaagcaguauagggaaaauguuugaagcaacugcccguggagcacgaaggauggccauccugggagacaccgcaugggacuucggcucuauaggaggaguguucacgucugugggaaaacugguacaccagaucuuuggaacugcguauggaguuuuguucagcgguguuucuuggaccaugaaaauaggaauagggauucugcugacauggcugggauuaaacucaaggagcacgucccuuucaaugacguguaucgcaguuggcauggucacacuguaccuaggagucaugguccaggcggacucgggauguguaaucaacuggaaaggcagagaacucaaauguggaagcggcauuuuugucacuaaugaaguucacaccuggacagagcaauacaaauuccaggcugacuccccaaagagacuaucagcagccauugggaaggcaugggaggaggguguguguggaauucgaucagccacucgucucgagaacaucauguggaagcaaauaucaaaugaauuaaaccacaucuuacuugaaaaugacaugaaauuuacagugguaguaggagacguuaguggaaucuuggcccaaggaaagaaaacgauuaggccacaacccauggaacacaaauacucguggaaaaguuggggaaaagccaaaaucauuggagcagauguucagaacacuaccuucaucaucgacggcccaaacaccccagaaugccccgaugaccaaagagcauggaacaucugggaaguugaagacuauggauuuggaauuuucacgacaaacauaugguugaaauugcgugauuccuacacccaagugugugaccaucgacuaaugucggcugccaucaaggauagcaaagcaguccaugcugacaugggguacuggauagaaagugaaaagaacgagacuuggaaguuggcaagagccuccuucauagaagucaagacaugcgucuggccaaaaucucacacucuauggagcaauggaguccuggaaagugagaugauaaucccaaagauauauggaggaccaauaucucagcacaauuacagaccaggauauuucacacaaacagcagggccguggcacuuaggcaaguuggaacuagauuuugauuugugugaagguaccacagugguuguggaugaacauuguggaaaucgcggaccaucucuuagaaccacaacagucacaggaaagauaauccaugaauggugcugcagaucuugcacguuacccccucuacguuucaaaggagaagacgggugcugguacggcauggaaauuagaccagucaaggagaaggaagagaaccuaguuaagucaauggucucugcagggucaggagaaguggacaguuuuucacuaggacuguuaugcauaucaauaaugaucgaagagguaaugagauccagauggagcaggaaaaugcugaugacuggaacauugguuguguuccuccuucucacauugggacaauugacauggaacgaucugaucaggcuaugcaucaugguuggagccaaugcuucagacaauauggggaugggaacaacguacuuagcuuugauggccacuuucagaaugagaccaauguucgcagucgggcuauuauuucgcagauuaacaucuagagaaguucuucuucucacgguuggauugagucugguggcaucuguagaacuaccaaauuccuuagacgagcuaggggauggacuugcaaugggcaucaugauauugaaauuacugacugauuuucaaucacaucagcuaugggccacuuugcugucucuaacauuugucaaaacaacucuuucacugcacuaugcauggaagacaauggccaugauacugucaauuguaucccuccucccuuuaugccuguccacgacuucucaaaaaacgacauggcuuccagugcuucugggaucucuuggaugcaaaccacuaaccauguuucucauaacagaaaacaaaaucuggggaaggaaaaguuggccucucaaugaaggaaucauggcuguuggaauaguuagcauucuacuaagcucacuucucaaaaaugaugugccacuagcuggcccauuaauagcuggaggcaugcuaauagcauguuaugucauauccggaagcucggccgauuuaucacuggagaaagcagcuaaggucuccugggaagaagaagcagaacacucuggcgccucacacaauauacuagucgagauccaagaugauggaaccaugaagauaaaggaugaagagagagaugacacgaucaccauccuccucaaagcaacccugcuggcaaucucagggguguauccaaugucaauaccggcgacucucuuuguguggcauuuuuggcagaaaaagaaacagagaucaggaguguuaugggacacacccagcccuccagaaguggaaaaagcaguccuugaugauggcauuuauagaauucuccaaagaggauuguugggcaggucucagguaggaguaggaguuuuccaagaaggcguauuccacacaauguggcacgucaccaggggagcuguucucauguaccaagggaagagauuggaaccaaguugggccagugucaaaaaagacuugaucucauauggaggagguuggagguuucaaggauccuggaacacgggagaagaagugcaggugauugcuguugaaccggggaagaacccaaaaaauguacagacagcgccagguaccuucaagacuucugaaggcgaaguuggagccauagcucuagacuucaaacccggcacaucuggaucuccuaucgugaacagagagggaaaaauaguaggucuuuauggaaauggaguggugacaacaaguggaaccuaugucagugcuauagcucaagcuaaagcaucacaagaagggccuuugccagagauugaggacgagguguuuaggaaaagaaacuuaacaauaauggaccuacacccaggaucgggaaaaacaagaagauaccuuccagccauaguccgugaggccauaaaaagaaagcugcgcacgcuaguucuagcucccacaagaguugucgccucugaaauggcagaggcgcucaagggaaugccaauaagguaucagacaacagcagugaagagugaacacacgggaaaggagauaguugaccuuaugugucacgccacuuucacuaugcgucuccuuucuccugugagaguucccaauuauaacaugauaaucauggaugaagcacauuuuaccgauccagccagcauagcagccagaggguacaucucaacccgaguggguaugggugaagcagcugcgauuuucaugacagccaccccccccggaucgguggaggccuuuccacagagcaaugcaguuauccaagaugaggaaaaagacauuccugaaagaucauggaacucaggcuaugacuggaucacugacuucccaggcaaaacagucugguuuguuccaagcaucaaaucaggaaaugacauugccaacuguuuaagaaagaaugguaaacgggugauccaauuaagcaggaaaacuuuugacacugaguaucagaaaacaaaaaauaacgacugggacuauguugucacaacagacauauccgaaaugggagcaaacuuucgagcugacaggguaauagacccaaggcggugccugaaaccgguuauacugaaagaugguccagagcgugucauucuagccggaccgaugccagugacuguggcuagugccgcccagaggagaggaagaauuggaaggaaccaaaauaaggaaggugaucaguauauuuacaugggacagccucuaaauaaugaugaggaccacgcccauuggacagaagcaaaaaugcuccuugacaacauaaacacaccagaagggaucaucccagcccucuuugagccggaaagagaaaagagugcugcaauagacggggaguacagacuacggggugaagcgaggaaaacguuuguggagcucaugagaagaggagaucuaccugucuggcuaucuuacaaagucgccucagaaggcuuccaauacuccgacagaagguggugcuuugauggggaaaggaacaaccagguguuggaggagaacauggacguggagaucuggacaaaagaaggagaaagaaagaaacugcgaccccgcuggcuggaugccagaacauacucugacccacuggcucugcgcgaauucaaagaguucgcagcaggaagaagaagcgucucaggugaccuaauauuagaaauagggaaacuuccacaacaucuaacgcaaagggcccagaaugcuuuggauaaucugguuaugcugcacaacucugaacaaggaggaaaagcuuauagacacgccauggaagaauugccagacaccauagagacaauaaugcuccuagcuuugauagcugugcugacugguggagugacgcuguucuuccuaucaggaagaggcuuagggaaaacauccauaggccuacucugcgugacguccucaagugcacuguuauggauggccaguguggagccccauuggauagcggccucuauuauacuagaguucuuucugaugguguugcuuauuccagagccagauagacagcgcacuccacaagacaaccaguuagcauauguggugauagguuugcuauucaugauauugacaguggcagccaaugagaugggauuauuggaaaccacaaagaaagaccuggggauuggucaugcagcugcugaaaaccaccaccacgccgcaaugcuggacguagaccuccauccagcuucagccuggacccucuacgcaguggccacaacgauuaucacucccaugaugagacacacaauugaaaacacaacggcaaauauuucccugacagcuauugcaaaccaggcagcuauauugaugggacuugauaagggauggccaauaucaaagauggacauaggaguuccacuucucgccuuggggugcuauucucaagugaacccgcugacgcugacagcagcgguacugaugcuaguagcccauuaugccauaauuggaccaggacugcaagcaaaagccacuagagaagcucaaaaaaggacggcagccggaauaaugaaaaacccaacugucgacgggaucguugcaauagauuuagacccugugguuuaugaugcaaaauuugaaaaacagcuaggccaaauaauguuguugauacuuugcacaucucagauucucuugaugcggaccacaugggccuugugugaauccaucacacuggccacaggaccucugaccacgcuuugggagggaucuccaggaaaauucuggaacaccacgauagcgguguccauggcaaacauuuuuagggguaguuaucuagcaggagcgggucuggccuuuucauuaaugaaaucucugggaggagguaggagagggacgggagcccaaggggaaacauugggagaaaaguggaaaagacagcugaaccaauugagcaagucagaauuuaacacuuacaagaggagugggauuauagaaguggauagaucugaagccaaggagggguugaaaagaggagaaacaaccaaacacgcagugucgagaggaacggccaaacugaggugguuuguggagaggaaccuugugaaaccagaagggaaagucauagaccucgguuguggaagagguggcuggucauauuauugcgcugggcugaagaaagucacagaagugaaaggauacacaaaaggaggaccuggacaugaggaaccgaucccaauggcaaccuauggauggaaccuaguaaagcuacacuccgggaaagauguauucuuuauaccaccugagaaaugugacacucuuuugugugauauuggugaguccucuccgaacccgacuauagaagaaggaagaacguuacguguucuaaagaugguagaaccauggcucagaggaaaccaauuuugcauaaaaauucuaaaucccuauaugccgagugugguagaaacucuggagcaaaugcaaagaaaacauggaggaauguuagugcgaaauccacucucaagaaauuccacucaugaaauguacuggguuucauguggaacaggaaacauugugucagcaguaaauaugacaucuagaaugcugcuaaaccgauucacaauggcucacaggaagccaacauaugaaagagauguggacuugggcgcuggaacgagacauguggcaguagaaccagagguggccaaccuagacaucauuggccagaggauagagaacauaaaaaaugaacacaaaucaacauggcauuaugaugaggauaauccguacaaaacaugggccuaucauggaucauaugaggucaagccaucaggaucagccucauccauggucaaugguguggugagacugcuaaccaaaccaugggaugucauucccauggucacacaaauagccaugacugacaccacacccuuuggacaacaaaggguguuuaaagagaaaguugauacgcgcacaccaaaagcgaaacgaggcacagcacaaaucauggaggugacggccaagugguuaugggguuuccucucuagaaacaaaaaacccagaaucugcacaagagaagaguuuacaagaaaagucaggucaaaugcagcuauuggagcaguguucguugaugaaaaucaauggaacucagcaaaagaagcaguggaagaugaaagguucugggaccuugugcgcagagagagggagcuucauaaacaaggaaaaugugcuacaugugucuacaacaugaugggaaagagagaaaaaaaauuaggagaguucggaaaggcaaaaggaagucgcgcaauaugguacaugugguugggagcgcgcuucuuagaguuugaagcccuuggcuucaugaaugaagaucacugguucagcagagagaauucacucaguggaguggagggagaaggacuccacaaacuuggauacauacucagagauauaucaaagauuccagggggaaauauguaugcagaugacacagccggaugggacacaagaauaacagaggaugaucuucagaaugaggccaaaaucacugacaucauggaaccugaacaugcccuacuggccacgucaaucuuuaagcuaaccuaccaaaauaagguuguaaggguacagagaccagcaaaaaauggaaccgugauggaugucauauccaggcgugaccagagaggaaguggacagguuggaacuuauggcuuaaacaccuucaccaacauggaggcccaacuaauaagacaaauggagucugaaggaaucuuuucacccagcgaauuggaaaccccaaauuuagccggaagaguccuugacugguuggaaaaacauggcaccgagaggcugagaagaauggcaaucaguggagaugacuguguggugaaaccaauugaugacagauuugcaacagccuuaacagccuugaaugacaugggaaagguaagaaaagacauaccgcaaugggaaccuucaaaaggauggaaugauuggcaacaagugcccuucugcucacaccacuuccaccagcugauuaugaaggaugggagggagauaguggugccaugccgcaaccaagaugaauugguagguagggccagagugucacaaggcgccggauggagcuugagagaaacugcaugucuaggcaagucguaugcacaaauguggcagcugauguacuuccacaggagagacuugagacuagcggcuaaugcuaucuguucagccguuccaguugauugggucccaaccagucgcaccaccuggucgauccaugcccaccaucaauggaugacaacagaagacauguugucaguguggaauagggucuggauagaggaaaacccauggauggaggauaaaacucauguguccagcugggaagacguuccauaccuagggaaaagggaagaucaaugguguggaucccuaauaggcuuaacagcacgagccaccugggccaccaacauacaaguggccauaaaccaagugagaaggcucauugggaaugagaauuaucuagacuacaugacaucaaugaagagauucaaaaacgagagugaucccgaaggggcacucugguaa

SEQ ID NO: 5543 - RNA, 9879 nt, Artificial Sequence
  derived and/or modified CDS sequence (wt) from DENV-1__GQ868602__SS-prME
ucugugaccaugcuccucaugcugcugcccacagcccuagcguuucaucugaccacccggggaggagagccgcacaugauaguuagcaagcaggaaagaggaaaaucacuuuuguuuaagaccucugcaggugucaacauguguacccuuauugcaauggauuugggagaguuaugugaggacacaaugaccuauaaaugccccaggaucacugagacggagccagaugacguugacuguuggugcaaugccacggagacaugggugaccuauggaacauguucucaaacuggugaacaccgacgagacaaacguuccgucgcauuggcaccacacguagggcuuggccuagaaacaagaaccgaaacguggauguccucugaaggcgcuuggagacaaauacaaaaaguggagacuugggcucugagacacccaggauucacggugauagcccuuuuucuagcacaugcuauaggaacauccaucacccagaaagggauuauuuuuauucugcugaugcuggugacuccauccauggccaugcggugcgugggaauaggcaacagagacuucguggaaggauugucaggagcuacguggguggaugugguauuggagcauggaaguugcgucacuaccauggcaaaagacaaaccaacacuggacauugaacuccugaagacggaggucacaaacccugcaguccugcgcaaacugugcauugaagcuaaaauaucaaacaccaccaccgauucgagauguccaacacaaggagaagcuacgcugguggaagagcaggacacgaacuuugugugccgacgaacguucguggacagaggcuggggcaauggcugugggcuauucggaaaagguagcuuaauaacgugugcuaaguuuaagugcgugacaaaacuggaaggaaagauaguccaauaugaaaacuuaaaauauucagucauagucaccguacacacuggagaccaacaccaaguuggaaaugagaccacagaacauggaacaacugcaaccauaacaccucaagcucccacgucggaaauacagcugacagacuacggagcucuaacauuggauuguucaccuagaacaggacuagacuuuaaugagaugguguuguugacaaugaaagaaaaaucauggcucguccacaaacaaugguuucuggaucuaccacugccuuggaccucgggggccucaacaucccaagagacuuggaauagacaagacuugcuggucacauuuaagacagcucaugcaaaaaagcaggaaguagucguacuaggaucacaagaaggagcaaugcacacugcgcugacuggagcgacagaaauccaaacgucuggaacgacaacaauuuuugcaggacaccugaaaugcagacuaaaaauggauaaacugaccuuaaaagggguaucauauguaaugugcacagggucauucaagcuagagaaggaaguggcugagacccagcauggaacuguucuagugcagguuaaauacgaaggaacagaugcaccaugcaagauccccuucucgucccaagaugagaagggaguaacccagaaugggagauugauaacagccaaccccauagucacugacaaagaaaaaccagucaacauugaagcggagccaccuuuuggugagagcuaccuugugguaggagcaggugaaaaagcuuugaaacuaagcugguucaagaagggaagcaguauagggaaaauguucgaagcaacugcccguggagcacgaaggauggccauccugggagacaccgcaugggacuucgguucuauaggagggguguucacgucugugggaaaacugauacaccagauuuuugggacugcauauggagucuuguucagcgggguuucuuggaccaugaaaauaggaauagggauucugcugacaugguuaggauuaaauucaaggagcacgucccuuucaaugacguguaucgcaguuggcauggucacacuguaccuaggagucaugguucaggcggacucgggauguguaaucaacuggaaaggcagagaacucaaauguggaagcggcauuuuugucaccaaugaaguccacaccuggacagagcaauacaaauuccaggccgacucccccaagagacuaucagcggccauagggaaggcaugggaggagggugugugugggauccgaucagccacucgucucgagaacauuauguggaagcaaauaucaaaugaauuaaaccacaucuuacuugaaaaugacaugaaauuuacaguggucguaggagacguuaauggagucuuggcccaaggaaagaaaaugauuaggccgcaacccauggaacacaaauacucguggaaaagcuggggaaaagccaaagucauaggagcagauguacaaaauaucaccuucaucaucgacggcccaaacaccccagaaugcccugaugaucaaagagcauggaauaucugggaagucgaagacuauggauuuggaauuuuuacgacaaacauaugguugaaauugcgugacuccuacacucaagugugugaccaccggcuaaugucagccgccaucaaggauagcaaagcaguccacgcugacaugggauacuggauagaaagugaaaagaacgagacuuggaaguugacaagagccuccuucauagaaguuaagacaugcaucuggccaaaaucccacacccuauggagcaauggagucuuggaaagugagaugauaaucccaaagauauauggaggaccaauaucucagcacaacuacagaccaggauauuucacacaaacagcagggccguggcacuugggcaaguuagaacuggauuuugguuugugugaagguaccacuguuguuguggaugaacauuguggaaaucgaggaccaucucuaagaaccacaacagucacaggaaagauaauccaugaauggugcuguagaucuugcacguuacccccccuacguuucaaaggagaagacggguguugguacgguauggaaaucagaccagucaaggagaaggaagagaaccuagucaagucaauggucucugcagggucaggagaaguggacaguuuuucacuaggacugcuaugcauaucaauaaugaucgaagagguaaugagauccagauggagcagaaaaaugcugaugacuggaacauuggcuguguuccuccuucuuauaaugggacaauugacauggaaugaucugaucaggcuauguaucaugguuggagccaaugcuucagacaagauggggaugggaacaacguaccuagcuuugauggccacuuucagaaugagaccaauguucgcagucgggcuacuguuucgcagauuaacaucuagagaaguucuucuucuuacaguuggauugagucuaguggcaucuguagaacuaccaaauuccuuggaggagcuaggggauggacuugcaaugggcaucaugauguugaaauuacugacugauuuucagucacaucagcuaugggcuaccuugcugucuuuaacauuugucaaaacaacuuuuucacugcacuaugcauggaagacaauggcuaugauacugucaauuguaucucucuucccuuuaugccuguccacgacuucucaaaaaacaacauggcuuccgguguugcugggaucucuuggaugcaaaccacuaaccauguuucuuauaacagaaaacaaaaucuggggaaggaaaagcuggccucucaaugagggaauuauggcuguuggaauaguuagcauucuucuaaguucacuucucaaaaaugauguaccacuagcuggcccacuaauagcuggaggcaugcugauagcauguuaugucauaucuggaagcucggcggauuuaucacuggagaaagcggcugaggucuccugggaagaagaagcagaacacucuggugccucacacaacauacuaguggagguccaagaugacggaaccaugaagauaaaagaugaagagagagaugacacacuuaccauucuccucaaagcaacuuugcuagcaaucucagggguauacccaaugucaauaccggcgacccucuuugugugguauuuuuggcagaagaagaaacagagaucaggagugcuaugggacacacccagcccuccagaaguggaaagagcaguucuugaugauggcaucuauagaauucuccaaagaggacuguugggcaaaucucaaguaggaguaggaguuuuucaagaagguguguuccacacaauguggcacgucaccaggggagcuguccucauguaccaagggaagagauuggaaccaaguugggccagugucaaaaaagacuugaucucauauggaggagguuggagguuucaaggauccuggaacaugggagaagaagugcaggugauugcuguugaaccggggaagaaccccaaaaauguacagacagcgccggguaccuuuaagaccccugaaggugaaguuggagccauagcccuagacuuuaaacccggcacaucuggaucuccuauugugaacagagagggaaaaauaguaggucuuuauggaaauggaguggugacaacaaguggaaccuacgucagugccauagcucaagccaaagcaucacaagaagggccucuaccagagauugaggacgagguguuuaggaaaagaaacuugacaauaauggaccuacauccaggaucgggaaaaacaagaagauaccuuccagccauaguccgugaggcuauaaaaagaaagcuacgcacgcuagucuuagcucccacaagaguugucgcuucugaaauggcagaggcgcucaagggaaugccaauaagguaccagacaacagcagugaaaagugaacacacgggaaaggagauaguugaccuuaugugucacgccacuuuuaccaugcgucuccucuccccugugagaguucccaauuauaauaugauuaucauggaugaagcacauuucacugauccggccaguauagcagccagaggguauaucucaacccgaguggguaugggugaagcagcugcaauuuucaugacagccacuccccccggaucgauggaggccuuuccacagagcaaugcagcuauccaagaugaggaaagagacauuccugaaaggucuuggaacucaggcuaugacuggauuacugauuucccagguaaaacaguuugguuuguuccaagcaucaaaucaggaaaugacauugccaacuguuuaagaaagaaugggaaacgggugguccaauugagcagaaaaaccuuugacacugaguaccagaagacaaaaaauaacgacugggacuauguugucacaacagacauauccgaaaugggagcaaacuuccgagcugacaggguaauagacccaaggcggugccuaaaaccgguaauacuaaaagauggcccagagcgugucauucuagccggaccgaugccagugacuguggcuagcgccgcccagaggagaggaagaauuggaaggaaccaaaauaaggaaggugaucaguauauuuacaugggacagccucuaaacaaugaugaggaccaugcccauuggacagaagcgaaaaugcuccuugacaacauaaacacaccagaagggauuaucccagcccucuuugagccggagagagaaaagagugcagcaauagauggggaauacagacuacggggugaagcgaggaaaacuuucguggagcuuaugagaagaggagaucuaccuguuuggcuauccuacaaaguugccucagaaggcuuccaguauuccgacagaagguggugcuuugauggagaaaggaacaaccaggugcuguugaagaacauggacguggagaucuggacaaaagaaggagaaagaaagaaacuacgaccccgcuggcuggaugccagaacauacucugacccacuggcucugcgcgaguucaaagaguucgcagcaggaagaagaagcgucucaggugaccuaauauuagaaauagggaaacuuccacaacaucuaacgcaaagggcccagaaugccuuggacaaccugguuaugcugcacaacucugaacagggaggaaaagccuauagacacgccauggaagaacuaccagacacuauagaaacguuaaugcuucuggcuuugauagcugugcugacugguggggugacguuguucuuccuaucaggaagggguuuagggaaaacauccauuggucuacucugcgugauggccucaagugcacuguuauggauggccaguguggaaccccauuggauagcggccucuaucauacuggaguucuuucugaugguguugcuuauuccagaaccggacagacagcgcacuccacaagacaaccagcuagcauacguggugauaggucuauuauucaugauauugacaguggcagccaaugagaugggauuacuggaaaccacaaagaaggaccuagggauuggucauguggcugcugaaagccaccaucaugcugcaaugcuggacguagaccuacauccagcuucagccuggacccucuaugcaguggccacaacaauuaucacucccaugaugagacacacaauugaaaacacaacggcaaacauuucccugacagcuaucgcaaaccaggcagcuauauugaugggacuugacaagggauggccaauaucaaagauggacauaggaguuccccuucuugccuuggggugcuauucucaggugaacccgcugacgcugacagcggcgguguugaugcuaguggcucauuacgcuauaauuggacccggacugcaagcaaaagcuacuagagaagcucaaaaaaggacagcagcuggaauaaugaaaaacccaacugucgaugggaucguugcaauagauuuggacccugugguuuacgaugcaaaauuugaaaaacagcuaggccaaauaaugcuguugauacuuugcacaucacagauucuccugaugcggaccacaugggccuugugugaauccaucacacuagccacuggaccucugaccacacucugggagggaucuccaggaaaauucuggaacaccacgauagcgguguccauggcaaauauuuuuaggggaaguuaucuagcaggagcaggucuggccuuuucauuaaugaaaucucuaggaggagguaggagaggcacgggagcccaaggggaaacacugggagaaaaauggaaaagacagcuaaaccaauugagcaagucagaauucaacacuuacaaaaggagugggaucauagagguggauagaucugaagccaaagagggguuaaaaagaggagaaacgacuaaacacgcggugucgagaggaacggccaaacugaggugguuuguagagaggaaccuugugaaaccagaagggaaagucauagaccucgguuguggaagagguggcuggucauauuacugcgcugggcugaagaaagucacagaagugaaaggauacacgaaaggaggaccugggcaugaggaaccaauuccaauggcaaccuauggauggaaccuaguaaaacuauacuccgggaaagauguauucuuuacaccaccugagaaaugugacacccuuuugugcgauauuggugaguccucuccgaacccaaccauagaagaaggaagaacguuacgaguucuaaagaugguggaaccauggcucagaggaaaccaauuuugcauaaaaguucuaaaucccuauaugccgagcgugguagaaacuuuggagcaaaugcaaagaaaacauggaggaaugcuagugcgaaauccacucucaagaaacuccacucaugaaauguacuggguuucauguggaacaggaaacauugugucagcaguaaacaugacaucuagaaugcugcuaaaucgauucacaauggcucacaggaagccaacauaugaaagagacguggacuuaggcgcuggaacaagaaauguggcaguagaaccagagguggccaaccuagauaucauuggccagaggauagaaaauauaaaaaaugaacacaaaucaacauggcauuaugaugaggauaauccauacaagacaugggccuaucauggaucauaugaggucaagccaucaggaucagccucauccauggucaaugguguggugagacugcuaaccaaaccaugggaugucauccccauggucacacaaauagccaugacugacacuacacccuuuggacaacagaggguguucaaagagaaaguugacacgcgcacaccaaaagcgaaacgaggcacagcacaaauuauggaggugacagccaggugguuauggggguuucucucuagaaacaaaaaacccagaauuuguacaagagaggaguucacaagaaaagucaggucaaacgcagccauuggagcaguguucauugaugaaaaucaauggaacucagcaaaagaggcaguggaagaugaacgguucugggaccuugugcacagagagagggagcuucauaaacaaggaaaaugugccacguguguuuacaacaugaugggaaagagagagaaaaaauuaggagaguuuggaaaggcaaaaggaagucgcgcaauaugguacaugugguugggagcgcguuuuuuagaguuugaagcccuugguuucaugaaugaagaucacugguucagcagagagaauucacuuaguggaguggagggagaaggacuccacaaacuuggauacauacucagagacauaucaaagauuccagggggaaauauguaugcagaugacacagccggaugggacacaagaauaacagaggaugaucuucagaaugaggcuaaaaucacugacaucauggaaccugaacaugcccuacuggccacgucaaucuuuaagcuaaccuaccaaaacaagguaguaagggugcagagaccagcaaaaaauggaaccgugauggaugucauauccagacgugaccagagaggaaguggacagguuggaaccuauggcuuaaacaccuucaccaacauggaggcccaacuaauaagacaaauggaaucugagggaaucuuuuuacccagcgaauuggaaaccccaaaucuagcugaaagaguccuugacugguuggaaaaacauggcaucgagaggcugaaaagaauggcaaucaguggagaugacuguguggugaaaccaauugaugacagauuugcaacagccuuaacagcuuugaaugacaugggaaagguaagaaaagacauaccacaaugggaaccuucaaaaggauggaaugauuggcaacaagugccuuucuguucacaccauuuccaccagcugaucaugaaggaugggagggagauaguggugccaugccgcaaccaagaugaacuuguggguagggccagaguaucacaaggcgccggauggagccugagagaaacugcaugccuaggcaagucauaugcacaaauguggcagcugauguacuuccacaggagagacuugagauuagcggcuaaugcuaucuguucagccguuccgguugauugggucccaaccagccgcaccaccuggucgauccaugcccaccaccaauggaugacaacagaagacauguugucaguguggaauagagucuggauagaggaaaacccauggauggaggacaaaacucauguguccaguugggaagacguuccauaccuaggaaaaagggaagaucaaugguguggaucccuaauaggcuuaacagcacgagccaccugggccaccaacauacaaguggccauaaaccaagugagaaggcucauugggaaugagaauuaucuagacuacaugacaucaaugaagagauucaaaaacgagaaugauccugaaggggcacucugguaa

SEQ ID NO: 5544 - RNA, 9879 nt, Artificial Sequence
  derived and/or modified CDS sequence (wt) from DENV-1__KF921911__SS-prME
ucugugaccaugcuccucaugcugcugcccacagcccuggcguuccauuugaccacacgagggggagagccacacaugauaguuaguaagcaggaaagaggaaagucacuguuguuuaagaccucuguaggcaucaauaugugcacucucauugcgauggauuugggagaguuaugcgaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggugccuggaaacaaauacaaaaaguggagacuugggcuuugagacacccaggauucacggugacagcccuuuuuuuagcacaugccauaggaacauccauuacucagaaagggaucauuuucauuuugcugaugcuaguaacaccaucaauggccaugcgaugugugggaauaggcaacagagacuucguugaaggacugucaggagcaacguggguggacgugguauuggagcauggaagcugcgucaccaccauggcaaaagauaaaccaacauuggacauugaacucuugaagacggaggucacaaacccugccgucuugcgcaaacugugcauugaagcuaaaauaucaaacaccaccaccgauucaagguguccaacacaaggagaggcuacacugguggaagaacaagacucgaacuuugugugucgacgaacguuuguggacagaggcugggguaauggcugcggacuauuuggaaaaggaagccuacugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugacugacuacggagcccucacauuggacugcucgccuagaacagggcuggacuuuaaugagaugguucuauugacaaugaaagaaaaaucauggcuuguccacaaacaaugguuucuagacuuaccacugccuuggacuucaggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaaggggaugucauauguaaugugcacaggcucauuuaagcuagagaaggaaguggcugagacccagcauggaacuguucuagugcagguuaaauacgaaggaacagaugcgccaugcaagaucccuuuuucggcccaagaugagaaaggagugacccagaaugggagauugauaacagccaaccccauagucacugacaaagaaaaaccagucaacauugagacagaaccaccuuuuggugagagcuacaucgugauaggggcaggugaaaaagcuuugaaacugagcugguucaagaaagggagcagcauagggaaaauguucgaagcaacugcccgaggagcacgaaggauggcuauccugggagacaccgcaugggacuuuggcucuauaggaggaguguucacaucagugggaaaauugguacaccagguuuuuggagccgcauaugggguucuguucagcgguguuucuuggaccaugaaaauaggaauagggauucugcugacaugguugggauuaaauucaaggagcacgucacuuucgaugacgugcauugcgguuggcauggucacacuguaccuaggagucaugguucaagcggacucgggauguguaaucaacuggaagggcagagaacucaaauguggaagugguauuuuugucacuaaugaaguccacacuuggacagagcaauacaaauuccaggcugacuccccaaaaagacugucagcagccauugggaaggcaugggaggagggcguguguggaauucgaucagccacgcgucuugagaacaucauguggaagcaaauaucaaaugaauugaaccauauucuacuugaaaaugacaugaaauucacagugguuguaggagaugcuaauggaauuuuggcccaagggaaaaaaaugauuaggccacaacccauggaacauagauacucauggaaaagcuggggaaaagccaaaaucauaggagcagacauacagaauaccaccuucaucaucgacggcccagauacuccagaaugccccgaugaccaaagagcguggaacauuugggaaguugaagacuauggguuuggaauuuucacgacaaacauauggcugaaauugcgcgacuccuacacccaaaugugugaccaccggcuaaugucagcugccaucaaagacagcaaggcaguccaugcugacaugggguacuggauagaaagugaaaagaacgagaccuggaagcuagcgagagccuccuucauagaagucaagacauguaucuggccgaaaucccacacucuauggaguaauggaguuuuggaaagugaaaugauaaucccaaagauauauggaggaccaauaucucagcacaacuacagaccaggguauuucacacaaacagcagggccauggcaccuaggcaagcuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacgcuucagaggagaagacggauguugguauggcauggaaaucagaccaguuaaggagaaggaggaaaaccuaguuaggucaauggucucugcagggucaggagaaguagacaguuuuucacuagggauacuaugcguaucaauaaugauugaagaagugaugagauccagauggaauagaaagaugcugaugacuggaacauuggcuguuuuccuccuucuuauaaugggacaacugacauggaaugaucugauuagguuaugcaucaugguuggagcuaaugcuucagacaggauggggaugggaacaacguaccuggccuugauggcuacuuucaaaaugagaccaauguucgcuguugggcuauuauuucgcagacuaacauccagagaaguucuucuucucacgauuggauugagccuaguggcauccguggaguuaccaaauucuuuggaggagcugggggauggacuugcaauggguaucaugauguuaaaauuauugacugaauuucagccacaccaguuauggaccaccuuacugucuuugacauuuaucaaaacaacucuuucauuggauuaugcauggaggacaauggcuauggugcugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuuaaaaaugaugugccguuagccggcccacuaauagcuggaggcaugcuaauagcauguuaugucauaucuggaagcucagccgauuuaucauuggagaaagcggcugagguauccugggaagaagaagcagaacacucugguaccucacacaacauauuaguagagguccaagaugauggaacuaugaaaauaaaagaugaagagagggaugacacacucaccauacuccucaaagcaacucugcuggcagucucaggaguguacccaaugucaauaccagcaacucuuuucgugugguacuuuuggcagaaaaagaaacagagaucaggaguguuaugggacacacccagcccuccggaaguggaaagagcaguucuugaugauggcaucuauagaauccugcaaagaggacuguugggcaggucccaaguaggagugggagucuuccaagacggcguguuccacacaauguggcacgucaccaggggagcuguccuuauguaccaagggaagagguuggaaccaagcugggccagugucaaaaaggacuugaucucauauggaggagguuggagauuucaaggaucauggaacacgggagaagaggugcaggugauagcuguugaaccaggaaaaaaucccaaaaauguacagacaacgccggguaccuucaagacucccgaaggcgaaguuggagccauagcucuagauuuuaaacccggcacaucuggaucucccaucgugaacagagagggaaaaauaguaagucuuuauggaaauggaguggugacaacaaguggaaccuacgucagugccauugcccaagcuaaaacaucacaagaagggccucuaccagagauugaggacgagguguuuaagaaaaggaacuuaacaauaauggaccugcauccaggaucgggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacucgaguggguaugggugaagcagcugcgaucuuuaugacagccacucccccaggaucgguggaggccuuuccacaaagcaaugcaguuauccaagaugaggaaagagacauuccugagagaucauggaacucagguuacgacuggaucacugauuuuccagguaaaacagucugguuuguuccaagcauuaagucaggaaaugacauugcuaacugcuuaagaaagaacggaaaacgggugauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccagugauacuaaaagaugguccagagcgugucauucuagccggaccgaugccagugacuguggccagugcugcccagagaagaggaagaauuggaaggaaccaaaacaaggaaggugaucaguacguuuauaugggacagccuuuaaauaaugaugaggaucacgcucauuggacagaagcaaaaaugcuccuugacaauauaaacacaccagaagggaucauuccagcccucuuugagccagagagagaaaagagugcagcaauugauggggaguacagacugcggggagaagcaaggaaaacguucguggagcucaugagaagaggagaucuaccaguuuggcuauccuacaaaguugccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccuucgugaguucaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggacaaccagcuagcauacguggugauagguuuguuauucaugauacugacaguggcagccaaugagaugggauuauuggaaaccacaaagaaagaccuggggauuggccauguagccgccgaaaaccaacaccaugccacgaugcuggacguagaccuacgcccagcuucagccuggacccucuaugcaguagccacaacaguuaucacuccuaugaugagacacacaauugaaaacacaacggcaaacauuucccugacagccauugcaaaccaggcagcuauauugaugggacuugacaagggauggccaauaucgaagauggacauaggaguuccacuucucgccuuagggugcuauucccaagugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaguuaggccaaauaauguuacugauacuuuguacaucacagauucucuugaugcggaccacaugggccuugugugaauccaucacacuggcuacuggacccuugaccacucucugggagggaucuccaggaaaauuuuggaauaccacgauagcaguguccauggcaaacaucuucaggggaaguuaucuagcaggagcaggucuggccuucucguuaaugaaaucuuugggaggaggcaggagagguacgggggcucaaggagaaacacugggagagaaauggaaaagacaguuaaaccaacugagcaagucagaauucaacaccuacaaaaggagugggauuauggagguggacagauccgaagccaaagagggauugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagucaagggauacacaaaaggaggaccuggacaugaggaaccuaucccaauggcgaccuauggauggaaccuaguaaagcuauacucuggaaaagauguauuuuuuacaccaccugagaaaugugauacccuucugugugacauaggagaguccucuccgaauccaacuauagaagaaggaagaacguuacguguucuaaagaugguagaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacuaaaucgauucacaauggcucacaggaagccaacauaugaaagagacguggacuuaggcgcuggaacaagacauguggcaguggaaccugagguagccaaccuagauaucauuggccagaggauagagaauauaaaaaaugaacacaagucaacauggcauuaugaugaagacaauccauacaaaacaugggccuaucauggaucauaugaggucaaaccaucaggaucagccucaucuauggugaauggcguggugagauugcucacaaaaccaugggaugucauccccauggucacacaaauagccaugaccgauaccacacccuucggacaacagagaguguuuaaagagaaaguggacacgcgcacaccaagagcaaaacgaggcacagcacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucguguacagagagagggagcuucauaaacagggaaaaugugccacgugugucuacaacaugauggggaagagagagaaaaaauugggagaguuuggaaaggcaaaaggaagucgugcaauaugguacauguggcugggagcacgcuuucuagaguucgaagcccuugguuucaugaaugaagaucacugguucaguagagagaauucauucaguggaguggaaggagaaggacugcacaaacuuggauacauacucagagacauaucaaagaucccggggggaaauauguaugcagaugacacagccggaugggacacaagaauaacagaggaugaucuucagaaugaggcuaaaaucacugacaucauggagccugaacacgcucuauuggcuacgucgauuuuuaagcugaccuaccaaaacaaggugguaagggugcaaagaccagcaaaaaauggaaccgugauggauguuauauccagacgagaucagagaggaagugggcaggucggaaccuauggcuuaaauacuuucaccaauauggagguccaacuaauaagacaaauggagucugaaggaaucuuuuuacccagcgaacuggaaacccccaaucuagcugagagaguucuugacugguuggaaaaacauggcaccgaaaggcugaaaagaauggcaauuagcggagaugauuguguggugaaaccgguugaugacagguuugcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauacgcacaaauguggcagcugauguacuuccacaggagagaccuaagacuagcggcuaaugcuaucuguucagcugucccaguugacugggucccaaccagccgcacaaccuggucaauccaugcucaccaucaauggaugacaacagaagauauguuaucaguguggaauaggguuuggauagaggaaaacccauggauggaggauaaaacucacguguccagcugggaagaagucccauacuuagggaaaagggaagaucaaugguguggaucccugauagguuugacagcgagggccacuugggccacuaacauacaaguagccauaaaccaagugagaaggcucaucgggaacgagaauuaucuagauuacaugacaucaaugaagagauucaagaaugagagugaucccgaaggggcacucugguaa

SEQ ID NO: 5545 - RNA, 9879 nt, Artificial Sequence
  derived and/or modified CDS sequence (wt) from DENV-1__KJ189350__SS-prME
uccgugaccaugcuccucaugcugcuucccacagcccuggcguuucauuugaccacacgagggggagagccacacaugauaguuaguaagcaggagagaggaaagucacucuuguuuaagaccucugcgggcgucaauaugugcacccucauagcgauggacuugggagaguuaugugaggacacaaugaccuacaaaugcccccggaucacugaggcagaaccagaugacguugacugcuggugcaaugccacagacacaugggugaccuaugggacguguucucaaaacggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguacuggagcauggaagcugugucaccaccauggcaaaaaauaaaccaacauuggacauugaacucuugaagacagaggucacgaacccugcugucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggggcccucacauuggacugcucaccuagaacagggcuggacuuuaacgagauggugcuauugacaaugaaagaaaaaucauggcuuguccacaaacaaugguuucuagacuugccacugccauggacuucgggggcuucaacaucccaagagaccuggaacagacaagaucugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugauaaagaaaaaccagucaacauugagacagaaccaccuuuuggugagagcuacaucgugguaggggcaggcgaaaaagcuuugaaacuaagcugguucaagagaggaagcagcauaggaaaaauguucgaagcaaccgcccgaggagcacgaaggauggcuauccugggagacaccgcaugggacuucgguucuauaggaggaguguucacaucugugggaaaauugguacaccagauuuuuggaaccgcauaugggguucuguucagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacucuccaaaaagacugucagcagccauuggaaaggcgugggaggagggcguguguggaauucgaucagccacgcgucuugagaacaucauguggaagcagauaucaaaugaauugaaccacauuuuacuugagaaugacaugaaauucacagugguuguaggagaugccaacggaaucuuggcccaaggaaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuggguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacgcuucagaggagaagacggguguugguauggcauggaaaucagaccagugaaggagaaggaggagaaucuaguuaggucaauggucucugcaggaucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucauggucggagcuaacgcuucagacaggauggggaugggaacaacguaccuagccuugauggcuacuuucaaaaugagaccaauguucgcuguagggcuauuauuccgcagacuaacauccagagaaguucuucuccucacgauuggauuaagccugguggcauccguggagcuaccaaauucuuuggaggagcuaggggauggacuugcaaugggcaucaugauguuaaaauuguugacugaauuucagccacaccaguuauggaccaccuuauugucucugacauuugucaaaacaacucucucauuggauuaugcauggaaaacaacggcuauggcacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccgguagcucagccgauuuaucauuggagaaagcggcugaaguauccugggaacaagaagcagaacauuccggugccucacacagcauauuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugauaauggcaucuauagaaucuugcaaagaggauuguugggcaggucccaaguaggagugggaguuuuccaagacggcguguuccacacaauguggcacguuaccaggggagcuguccuuauguaccaagggaagagacuggaaccaagcugggccaguguaaaaaaggacuugaucucauauggaggagguuggagguuccaaggaucauggaacacgggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguauuuaagaaaagaaacuuaacaauaauggaccugcacccaggaucagggaaaacaagaagauaucuuccagccauaguccgugaggccauaaaaaggaaacugcguacguuaauccuggcucccacaagaguugucgccucugaaauggcagaggcacucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacugcggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcuuaugagaagaggagaucuaccaguuuggcuauccuacaaaguagccucagaagguuuccaguacuccgacagaagguggugcuuugauggggagaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuacuagcuuugauagcuguguugacuggcggagugacgcuguucuuccuaucaggaaaaggccuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugccacaaugcuggacguagaccuacacccagcuucagccuggacccucuaugcaguagccacaacagucaucacucccaugaugagacauacaauugaaaauacaacggcaaacauuucccuaaccgccauugcaaaucaggcagcuauauugaugggacuugacaagggauggccaauaucgaagauggacauaggaguuccacuucucgcuuuagggugcuauucucaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaacuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaauauuuucaggggaaguuaucuagcaggagcaggucuggcuuucucauuaaugaaaucuuuaggaggagguaggagaggcacgggagcucaaggggaaacacugggagagaaauggaaaagacaguugaaccaacugagcaagucagaauucaacaccuacaaaaggagugggauuauggagguggacagauccgaagccaaagagggacugaaaagaggagaaacaaccaaacaugcagugucaagaggaacagccaaacugaggugguuuguggagaggaaccucgugaaaccagaaggaaaagucauagaccucgguuguggaagagguggcuggucauauuauugugcugggcugaagaaagucacugaagugaagggauacacaaaaggaggaccuggacaugaagaaccuaucccaauggcgaccuauggauggaaccuaguaaaacuacacucuggaaaggauguauuuuuuaugccaccugagaaaugugacacccuucugugugauauuggugaguccucuccgaauccaaccauagaagaaggaagaacguuacguguucuaaaaaugguggaaccauggcucagaggaaaccaauucugcauaaaaaucuuaaauccuuacaugccaagugugguagaaacucuggagcgaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacgaaaccaugggaugucauccccauggucacacaaauagcuaugacugauaccacacccuuuggacaacagagaguguuuaaagagaaaguugacacgcguacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagauuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagacgauacagccggaugggacacaagaguaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaacauggagguccaacuaauaagacaaauggagucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccaacugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggagaacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugauuccgaaggagcacucugguaa

SEQ ID NO: 5546 - RNA, 9879 nt, Artificial Sequence
  derived and/or modified CDS sequence (wt) from DENV-1__KJ189351__SS-prME
uccgugaccaugcuccucaugcugcugcccacaguccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauuuacggugauagccuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguacuggagcauggaagcugcgucaccaccauggcaaaaaauaaaccaacauuggacauugaacuccugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuccgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagauuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucaacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauauggaguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaaggcugucagcagccauuggaaaggcaugggaggagggcguguguggaauucgaucagccacgcgucuugagaacaucauguggaagcagauaucaaaugaauugaaccacauucuacuugagaaugacaugaaauucacagugguuguaggagaugccaacggaauuuuggcccaaggaaaaaaaaugauuaggccacaacccauggaacacaaauacucauggaaaagcuggggaaaagcuaaaaucauaggagcagacauacaaaauaccaccuucauuaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacggcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccagugaaggagaaggaggagaaucuaguuaggucaauggucucugcagggucaggagaaguggauaguuuuucauuaggaauacuauguguaucaauaaugauugaagaagugaugagauccagauggaguagaaagaugcugaugacuggaacacuggcuguuuuccuccuucuuauaaugggacaacugacauggaaugaucugacuagguuaugcaucaugguuggagcuaaugcuucagacaggauggggaugggaacaacguaccuagccuugauggcuacuuucaaaaugagaccaauguucgcuguagggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucauuggauuaugcauggaaaacaacggcuauggcacugucuaucguaucucucuuuccuuuaugccugucuacgaccucccaaaaaacaacauggcuuccggugcuguuaggaucuuuuggaugcaaaccauuaaccauguuucuuauagcagaaaacagaaucuggggaaggaaaaguuggccccucaaugaaggaauuauggcuauuggaauagucagcauucuacuaagcucacuccucaaaaaugauguaccguuggccgggccacuaauagcuggaggcaugcugauagcauguuaugucauauccggaagcucagccgauuuaucauuggagaaagcggcugaaguauccugggaacaagaagcagaacacuccggugccucacacagcauauuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguccuugauaauggcaucuauagaaucuugcaaagaggacuguuggguaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacgggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguauuuaagaaaagaaacuuaacaauaauggaucugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagucaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggggaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggagcaaauuuccgggccgacaggguaauagacccaaggcggugcuugaaaccgguaauacuaaaagaugguccagagcgugucauucuagccggaccgaugccggugacuguggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaagaaggagaaagaaagaaauugcgaccucgcugguuggacgccagaacauacucugauccauuggcccugcgcgaguucaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucagggaaaggccuagggaaaacaucuauuggcuugcucugugugacggccucaagcgcacuguuauggauggccaguguggagccccauuggauagcggccuccaucauauuggaguucuuuuugauggugcugcucauuccagagccagacagacaacgcacuccacaggacaaccagcuagcauauguggugauagguuuguuauucaugauacugacaguggcagccaaugagaugggauuacuggaaaccacaaagaaagaccuggggauuggcuauguagccgccgaaaaccaccaacaugccacaaugcuggacguagaccuacacccagcuucagccuggacccucuaugcaguagcuacaacagucaucacuccuaugaugagacacacaauugaaaauacaacggcaaacauuucccugaccgccauugcaaaccaggcagcuauauugaugggacuugacaagggauggccaauaucaaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaauaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaucuacaaaaggagugggauuauggagguggacagauccgaagccaaagagggacugaaaagaggagaaacaaccaaacaugcagugucaagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauucuuuaugccaccugagaaaugugacacccuucugugugauauuggugaguccucuccgaauccaacuauagaagaaggaagaacguuacguguucuaaaaaugguggaaccauggcucagaggaaaccaauucugcguaaaaauccuaaauccuuacaugccaagugugguagagacucuggagcgaaugcaaagaaaacauggagggaugcuagugcgaaacccacucucaagaaauucuacccaugaaauguacuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagucaucaggaucagccucaucuauggugaauggaguggugagauugcuuacgaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugaccgccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggccaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacagauggagucugaaggaaucuuuuuacccagcgaauuggaaacccccaaccuagcugagagggcucuugauugguuagaaaaacauggugccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagcuugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggauaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugauuccgaaggagcacucugguaa

SEQ ID NO: 5547 - RNA, 9879 nt, Artificial Sequence
  derived and/or modified CDS sequence (wt) from DENV-1__KJ189352__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguacuggagcacggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggccacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuugccacugccauggacuucgggggcuucaacaucccaagagaccuggaacagacaagauuugcuggucacauucaagacagcucaugcaaagaaacaggaaguagucguauugggaucacaggaaggagcaaugcauacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagauuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcgugggaggagggcguguguggaauucgaucagccacgcgucuugagaacaucauguggaggcagauaucaaaugaauugaaccacauuuuacuugagaaugacaugaaauucacagugguuguaggagaugccaacggaauuuuggcccaaggaaaaaaaaugauuaggccacaacccauggaacacaaauacucauggaaaagcuggggaaaagcuaaagucauaggagcagacauacaaaauaccaccuucauuaucgacggcccagacaccccagaauguccugauggccaaagagcauggaacauuugggaaguugaggacuauggguuuggaguuuucacgacaaauauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaaaacauguaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaaggcaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccagugaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcugucuuccuccuucuuauaaugggacaacugacauggaaugaucugauuagguuaugcaucauggucggagcuaacgcuucagacaggauggggaugggaacaacguaccuagccuugauggcuacuuucaaaaugagaccaauguucgcuguagggcuauuauuccgcagacuaacauccagagaaguucuucuccucacgauuggauuaagccugguggcauccguggagcuaccaaauuccuuggaggagcuaggggauggacuugcaauggguaucaugauguuaaaauuguugacugaauuucagccacaccaguuauggaccaccuuauugucucugacauuugucaaaacaacucucucauuggauuaugcauggaaaacaacugcuauggcacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccauuaauagcuggaggcaugcuaauagcauguuaugucauauccgguagcucagccgauuuaucauuggagaaagcggcugaaguauccugggaacaagaagcagaacacuccggugccucacacagcauauuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugauaauggcaucuauagaaucuugcaaagaggauuguugggcaggucccaaguaggagugggaguuuuccaagacggcguguuccacacaauguggcacguuaccaggggagcuguccuuauguaccaagggaagagacuggaaccaagcugggccagugugaaaaaggacuugaucucauauggaggagguuggagguuccaaggaucauggaacacgggagaagaagugcagguaauagcuguugaaccaggaaaaaaccccaaaaauguacagacaacgccgggcaccuucaagacuccugaaggcgaaguuggagccauagcucuagauuucaaacccggcacaucuggaucucccaucgugaacagagagggaaaaauagugggucuguauggaaauggaguggugacaacaaguggaaccuacgucagugccauugcccaagcuaaagcaucacaggaagggccucuaccagagauugaggacgagguauuuaagaaaagaaacuuaacaauaauggaccugcacccaggaucagggaaaacaagaagauaucuuccagccauaguccgugaggccauaaaaaggaaacugcguacguuaauccuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacugcggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccugauauuggaaauagggaaacuuccacaacauuugacguuaagagcccagaaugcucuggacaacuuggucauguugcacaauuccgaacaaggaggaaaagccuacagacaugcuauggaggaacuaccagacaccauagaaacauugaugcuacuagcuuugauagcuguguugacugguggagugacgcuguucuuccuaucaggaaaaggccuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugccacaaugcuggacguagaccuacacccagcuucagccuggacccucuaugcaguagccacaacagucaucacucccaugaugagacacacaauugaaaauacaacggcaaacauuucccugaccgccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcccaaaaaaggacagcagccggaauaaugaaaaauccaaccguagacgggauuguugcaauagacuuggauccugugguuuaugaugcaaaauuugaaaaacaacuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaauauuuucaggggaaguuaucuagcaggagcaggucuggcuuucucauugaugaaaucuuuaggaggagguaggagaggcacgggagcucaaggggaaacacugggagagaaauggaaaagacaguugaaccaacugagcaagucagaauucaacaccuacaaaaggagugggauuauggagguggacagauccgaagccaaagagggacugaaaagaggagaaacaaccaaacaugcagugucaagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaaacuacacucuggaaaggauguauuuuuuaugccaccugagaaaugugacacucuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcgaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagaaaauauaaaaaaugaacacaagucaacauggcauuaugaugaggacaauccauacaaaacaugggccuaucauggaucauaugaggucaagccaucaggaucagccucaucuauggugaauggaguggugagauugcucacgaaaccaugggaugucauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuuuaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaguaacagaggaugaccuccagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagagggaguggacaggucggaacuuauggcuuaaauacuuucaccaauauggagguccaacuaauaagacaaauggagucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaaggaaagacauaccgcagugggaaccuucaaaaggauggaaugauuggcagcaagugccuuuuuguucacaccauuuccaccaacugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggagaacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugauuccgaaggagcacucugguaa

SEQ ID NO: 5548 - RNA, 9879 nt, Artificial Sequence
  derived and/or modified CDS sequence (wt) from DENV-1__KJ189353__SS-prME
uccgugaccaugcuccucaugcugcuucccacagcccuggcguuucauuugaccacacgagggggagagccacacaugauaguuaguaagcaggagagaggaaagucacucuuguuuaagaccucugcgggcgucaauaugugcacccucauugcgauggacuugggagaguuaugugaggacacaaugaccuacaaaugcccccggaucacugaggcagaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguacuggagcauggaagcugugucaccaccauggcaaaaaauaaaccaacauuggacauugaacucuugaagacagaggucacgaacccugcugucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggggcccucacauuggacugcucaccuagaacagggcuggacuuuaacgagauggugcuauugacaaugaaagaaaaaucauggcuuguccacaaacaaugguuucuagacuugccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggacaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguucacaucugugggaaaauugguacaccagauuuuuggaaccgcauaugggguucuguucagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauauaaauuccaggcugacucuccaaaaagacugucagcagccauuggaaaggcgugggaggagggcguguguggaauucgaucagccacgcgucuugagaacaucauguggaagcagauaucaaaugaauugaaccacauuuuacuugagaaugacaugaaauucacagugguuguaggagaugccaacggaaucuuggcccaaggaaaaaaaaugauuaggccacaacccauggaacacaaauacucauggaaaagcuggggaaaagcuaaaaucauaggagcggacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuggguaagcuggaacuggauuuugaauugugugaagguaccacaguuguuguggaugaacauuguggaaaucgagguccaucucucagaaccacaacagucacaggaaagauaauccaugaaugguguugcagauccugcacgcuaccccccuuacgcuucagaggagaagacggguguugguauggcauggaaaucagaccagugaaggagaaggaggagaaucuaguuaggucaauggucucugcaggaucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucauggucggagcuaacgcuucagacaggauggggaugggaacaacguaccuagccuugauggcuacuuucaaaaugagaccaauguucgcuguagggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucauuggauuaugcauggaaaacaacggccauggcacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccgguagcucagccgauuugucauuggagaaagcggcugaaguauccugggaacaagaagcagaacauuccggugccucacacagcauauuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugauaauggcaucuauagaaucuugcaaagaggauuguugggcaggucccaaguaggagugggaguuuuccaagacggcguguuccacacaauguggcacguuaccaggggagcuguccuuauguaccaagggaagagacuggaaccaagcugggccaguguaaaaaaggacuugaucucauauggaggagguuggagguuccaaggaucauggaacacgggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguauuuaagaaaagaaacuuaacaauaauggaccugcacccaggaucagggaaaacaagaagauaucuuccagccauaguccgugaggccauaaaaaggaaacugcguacguuaauccuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacugcggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcuuaugagaagaggagaucuaccaguuuggcuauccuacaaaguagccucagaagguuuccaguacuccgacagaagguggugcuuugauggggagaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuacuagcuuugauagcuguguugacugguggagugacgcuguucuuccuaucaggaaaaggccuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugccacaaugcuggacguagaccuacacccagcuucagccuggacccucuaugcaguagccacaacagucaucacucccaugaugagacauacaauugaaaauacaacggcaaacauuucccuaaccgccauugcaaaucaggcagcuauauugaugggacuugacaagggauggccaauaucgaagauggacauaggaguuccacuucucgccuuagggugcuauucucaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaacuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaauauuuucaggggaaguuaucuagcaggagcaggucuggcuuucucauuaaugaaaucuuuaggaggagguaggagaggcacgggagcucaaggggaaacacugggagagaaauggaaaagacaguugaaccaacugagcaagucagaauucaacaccuacaaaaggagugggauuauggagguggacagauccgaagccaaagagggacugaaaagaggagaaacaaccaaacaugcagugucaagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaagaaccuaucccaauggcgaccuauggauggaaccuaguaaaacuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaaucuuaaauccuuacaugccaagugugguagaaacucuggagcgaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacgaaaccaugggaugucauccccauggucacacaaauagcuaugacugauaccacacccuuuggacaacagagaguguuuaaagagaaaguugacacgcguacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagauuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagacgauacagccggaugggacacaagaguaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaacauggagguccaacuaauaagacaaauggagucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccaacugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggagaacaaaacucauguaucuaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugauuccgaaggagcacucugguaa

SEQ ID NO: 5549 - RNA, 9879 nt, Artificial Sequence
  derived and/or modified CDS sequence (wt) from DENV-1__KJ189354__SS-prME
uccgugaccaugcuccucaugcugcuucccacagcccuggcguuucauuugaccacacgagggggagagccacacaugauaguuaguaagcaggagagaggaaagucacucuuguuuaagaccucugcgggcgucaacaugugcacccucauugcgauggacuugggagaguuaugugaggacacaaugaccuacaaaugcccccggaucacugaggcagaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguacuggagcauggaagcugugucaccaccauggcaaaaaauaaaccaacauuggacauugaacucuugaagacagaggucacgaacccugcugucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggggcccucacauuggacugcucaccuagaacagggcuggacuuuaacgagauggugcuauugacaaugaaagaaaaaucauggcuuguccacaaacaaugguuucuagacuugccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguucacaucugugggaaaauugguacaccagauuuuuggaaccgcauaugggguucuguucagcgguguuucuuggaccaugaaaauagggauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacucuccaaaaagacugucagcagccauuggaaaggcgugggaggagggcguguguggaauucgaucagccacgcgucuugagaacaucauguggaagcagauaucaaaugaauugaaccacauuuuacuugagaaugacaugaaauucacagugguuguaggagaugccaacggaaucuuggcccaagggaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuggguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacgcuucagaggagaagacggguguugguauggcauggaaaucagaccagugaaggagaaagaggagaaucuaguuaggucaauggucucugcaggaucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucauggucggagcuaacgcuucagacaggauggggaugggaacaacguaccuagccuugauggcuacuuucaaaaugagaccaauguucgcuguagggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucauuggauuaugcauggaaaacaacggcuauggcacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccgguagcucagccgauuuaucauuggagaaagcggcugaaguauccugggaacaagaagcagaacauuccggugccucacacagcauauuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugauaauggcaucuauagaaucuugcaaagaggauuguugggcaggucccaaguaggagugggaguuuuucaagacggcguguuccacacaauguggcacguuaccaggggagcuguccuuauguaccaagggaagagacuggaaccaagcugggccaguguaaaaaaggacuugaucucauauggaggagguuggagguuccaaggaucauggaacacgggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguauuuaagaaaagaaacuuaacaauaauggaccugcacccaggaucagggaaaacaagaagauaucuuccagccauaguccgugaggccauaaaaaggaaacugcguacguuaauccuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucuccuauccccagugagaguucccaauuacaacaugauuauuauggaugaagcgcauuuuaccgauccagcuagcauagcggcuagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacugcggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcuuaugagaagaggagaucuaccaguuuggcuauccuacaaaguagccucagaagguuuccaguacuccgacagaagguggugcuuugauggggagaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggagggaaagccuacagacaugcuauggaggaacuaccagacaccauagaaacauugaugcuacuagcuuugauagcuguguugacugguggagugacgcuguucuuccuaucaggaaaaggccuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugccacaaugcuggacguagaccuacacccagcuucagccuggacccucuaugcaguagccacaacagucaucacucccaugaugagacauacaauugaaaauacaacggcaaacauuucccuaaccgccauugcaaaucaggcagcuauauugaugggacuugacaagggauggccaauaucgaagauggacauaggaguuccacuucucgccuuagggugcuauucucaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaacuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaauauuuucaggggaaguuaucuagcaggagcaggucuggcuuucucauuaaugaaaucuuuaggaggagguaggagaggcacgggagcucaaggggaaacacugggagagaaauggaaaagacaguugaaccaacugagcaagucagaauucaacaccuacaaaaggagugggauuauggagguggacagauccgaagccaaagagggacugaaaagaggagaaacaaccaaacaugcagugucaagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaagaaccaaucccaauggcgaccuauggauggaaccuaguaaaacuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaaucuuaaauccuuacaugccaagugugguagaaacucuggagcgaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagaaaauauaaaaaaugaacacaagucaacauggcauuaugaugaggacaauccauacaaaacaugggccuaucauggaucauaugaggucaagccaucaggaucagccucaucuauggugaauggaguggugagauugcucacgaaaccaugggaugucauccccauggucacacaaauagcuaugacugauaccacacccuuuggacaacagagaguguuuaaagagaaaguugacacgcguacaccaagagcaaaacgaggcacaacacagaucauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaaaauuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagacgauacagccggaugggacacaagaguaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaacauggagguccaacuaauaagacaaauggagucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccaacugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggagaacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuauuuagauuauaugacaucaaugaagagauucaagaaugagagugauuccgaaggagcacucugguaa

SEQ ID NO: 5550 - RNA, 9879 nt, Artificial Sequence
  derived and/or modified CDS sequence (wt) from DENV-1__KJ189355__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaagcguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguacuggagcacggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggccacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuugccacugccauggacuucgggggcuucaacaucccaagagaccuggaacagacaagauuugcuggucacauucaagacagcucaugcaaagaaacaggaaguagucguauugggaucacaggaaggagcaaugcauacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuauugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagauuuuuggaaccgcauaugggguucuguuuagcgguguuucuuggaccaugaaaauaggaauagggauucugcugacaugguugggauuaaauucaaggagcaugucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcgugggaggagggcguguguggaauucgaucagccacgcgucuugagaacaucauguggaagcagauaucaaaugaauugaaccacauuuuacuugagaaugacaugaaauucacagugguuguaggagaugccaacggaauuuuggcccaaggaaaaaaaaugauuaggccacaacccauggaacacaaauacucauggaaaagcuggggaaaagcuaaaaucauaggagcagacauacaaaauaccaccuucauuaucgacggcccagacaccccagaauguccugauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaaaacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccagugaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcugucuuccuccuucuuauaaugggacaacugacauggaaugaucugauuagguuaugcaucauggucggagcuaacgcuucagacaggauggggaugggaacaacguaccuagccuugauggcuacuuucaaaaugagaccaauguucgcuguagggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucauuggauuaugcauggaaaacaacggcuauggcacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccauuaauagcuggaggcaugcuaauagcauguuaugucauauccgguagcucagccgauuuaucauuggagaaagcggcugaaguauccugggaacaagaagcagaacacuccggugccucacacagcauauuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugauaauggcaucuauagaaucuugcaaagaggauuguugggcaggucccaaguaggagugggaguuuuccaagacggcguguuucacacaauguggcacguuaccaggggagcuguccuuauguaccaagggaagagacuggaaccaagcugggccagugugaaaaaggacuugaucucauauggaggagguuggagguuccaaggaucauggaacacgggagaagaagugcagguaauagcuguugaaccaggaaaaaaccccaaaaauguacagacaacgccgggcaccuucaagacuccugaaggcgaaguuggagccauagcucuagauuucaaacccggcacaucuggaucucccaucgugaacagagagggaaaaauagugggucuguauggaaauggaguggugacaacaaguggaaccuacgucagugccauugcccaagcuaaagcaucacaggaagggccucuaccagagauugaggacgagguauuuaagaaaagaaacuuaacaauaauggaccugcacccaggaucagggaaaacaagaagauaucuuccagccauaguccgugaggccauaaaaaggaaacugcguacguuaauccuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacugcggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccugauauuggaaauagggaaacuuccacaacauuugacguuaagagcccagaaugcucuggacaacuuggucauguugcacaauuccgaacaaggaggaaaagccuacagacaugcuauggaggaacuaccagacaccauagaaacauugaugcuacuagcuuugauagcuguguugacugguggagugacgcuguucuuccuaucaggaaaaggccuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugccacaaugcuggacguagaccuacacccagcuucagccuggacccucuaugcaguagccacaacagucaucacucccaugaugagacacacaauugaaaauacaacggcaaacauuucccugaccgccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcccaaaaaaggacagcagccggaauaaugaaaaauccaaccguagacgggauuguugcaauagacuuggauccugugguuuaugaugcaaaauuugaaaaacaacuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaauauuuucaggggaaguuaucuagcaggagcaggucuggcuuucucauugaugaaaucuuuaggaggagguaggagaggcacgggagcucaaggggaaacacugggagagaaauggaaaagacaguugaaccaacugagcaagucagaauucaacaccuacaaaaggagugggauuauggagguggacagauccgaagccaaagagggacugaaaagaggagaaacaaccaaacaugcagugucaagaggaacagccaaacugaggugguuuguggagaggaaccucgugaaaccagaaggaaaagucauagaccucgguuguggaagagguggcuggucauauuauugugcugggcugaagaaaguuacugaagugaagggauacacgaaaggaggaccuggacaugaggaaccuaucccaauggcgaccuauggauggaaccuaguaaaacuacacucuggaaaggauguauuuuuuaugccaccugagaaaugugacacucuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcgaaugcaaagaaaacauggagggaugcuagugcgaaacccacucucaagaaauucuacucaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggagccagagguagccaaccuagauaucauuggccagaggauagaaaauauaaaaaaugaacacaagucaacauggcauuaugaugaggacaauccauacaaaacaugggccuaucauggaucauaugaggucaagccaucaggaucagccucaucuauggugaauggaguggugagauugcucacgaaaccaugggaugucauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuuuaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaguaacagaggaugaccuccagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagagggaguggacaggucggaacuuauggcuuaaauacuuucaccaauauggagguccaacuaauaagacaaauggagucugaaggaaucuuuuuacccagcgaauuggaaacccccaaccuagcugagagggcucuuggcugguuagaaaaacauggcgccgaaaggcugaaacgaauggcaaucagcggagaugauugcguggugaaaccaauugacgacagguucgcaacagccuuaacagcucugaaugacaugggaaaaguaaggaaagacauaccgcagugggaaccuucaaaaggauggaaugauuggcagcaagugccuuuuuguucacaccauuuccaccaacugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggagaacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuauuuagauuacaugacaucgaugaagagauucaagaaugagagugauuccgaaggagcacucugguaa

SEQ ID NO: 5551 - RNA, 9879 nt, Artificial Sequence
  derived and/or modified CDS sequence (wt) from DENV-1__KJ189358__SS-prME
uccgugaccaugcuccucaugcugcugcccacaguccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugacuuaugggacguguucucaaaccggcgaacaccgacgagagaagcguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguacuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucguggugggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaaggcugucagcagccauuggaaaggcaugggaggagggcguguguggaauucgaucagccacgcgucuugagaacaucauguggaagcagauaucaaaugaauugaaccacauucuacuugagaaugacaugaaauucacagugguuguaggagaugccaacggaaucuuggcccaagggaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaucggcuaaugucagcugccaucaaggacagcaaggcaguucaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacggccgggccauggcaucuagguaaguuggaacuggauuuugacuugugugaagguaccacaguuguuguggaugaacauuguggaaaccgagguccaucucucagaaccacaacagucacaggaaagauaauccaugaaugguguugcagauccugcacgcuaccccccuuacguuucagaggagaagacggauguugguauggcauggaaaucagaccagugaaggagaaggaggagaaucuaguuaggucaauggucucugcagggucaggagaaguggauaguuuuucauuaggaauacuaugcguaucaauaaugauugaagaagugaugagauccagauggaguagaaagauguugaugacuggaacacuggcuguuuuccuccuucuuauaaugggacaacugacauggaaugaucugauuagguuaugcaucaugguuggagcuaaugcuucagacaggauggggaugggaacaacgcaccuagccuugauggcuacuuucaaaaugagaccaauguucgcuguaggguuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuccagccauaccaguuauggaccaccuuauugucucugacauuugucaaaacaacucucucauuggauuacgcauggaaaacaacggcuauggcacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaagaaugauguaccguuggccgggccacuaauagcuggaggcaugcuaauagcauguuaugucauauccggaagcucagccgauuuaucauuggagaaagcggcugaaguauccugggaacaagaagcagaacacuccggugccucacacagcauauuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguauuucuggcagagaaagaaacagagaucaggaguguuaugggacacacccagcccuccggaaguggaaagagcaguucuugauaauggcaucuauagaaucuugcaaagaggacuguugggcaggucccaaguaggagugggagucuuccaagacggcguguuccacacaauguggcacguuaccaggggagcuguccucauguaccaagggaagagacuggaaccaagcugggccagugucaaaaaggacuugaucucauauggaggagguuggagguuccaaggaucauggaacacgggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagccaaagcaucacaggaagggccucuaccagagauugaggacgagguauuuaagaaaagaaacuuaacaauaauggaccugcacccaggaucagggaaaacaagaaaauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaauaugauuauuauggaugaagcacauuuuaccgauccagcuagcauagcggccagaggguacaucucaacccgaguggguaugggugaagcagcugcgaucuuuaugacagccacucccccuggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggagcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaauacaccagaagggaucaucccagcucuuuuugagccagagagagaaaagagugcagcaauagacggggaguacagacugcggggagaagcaaggaaaacguucguggagcucaugagaagaggagaucuaccaguuuggcuauccuacaaaguagcuucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagauaccauagaaacauugaugcuucuagcuuugauagcuguguugacugguggagugacgcuguucuuccuaucagggaaaggccuagggaaaacaucuauuggcuugcucugugugacggccucaagcgcacuguuauggauggccaguguggagccccauuggauagcggccuccaucauacuagaguucuuuuugauggugcugcucauuccagagccagacagacaacgcacuccacaggacaaccagcuagcauauguggugauagguuuguuauucaugauacugacaguggcagccaaugagaugggauuacuggaaaccacaaagaaagaccuggggauuggcuauguagccgccgaaaaccaccaacaugccacaaugcuggacguagaccuacacccagcuucagccuggacccucuaugcaguagccacaacagucaucacucccaugaugagacacacaauugaaaauacaacggcaaacauuucccugaccgccauugcaaaucaggcagcuauauugaugggacuugacaagggauggccaauaucaaagauggacauaggaguuccacuucucgccuuagggugcuauucccaggugaacccauugacacugacagcggcaguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuaugggagggaucuccaggaaaauucuggaauaccacaauagcaguguccauggcaaauaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauuuaacaccuacaaaaggagugggauuauggagguggacagauccgaagccaaagagggacugaaaagaggagaaacaaccaaacaugcagugucaagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaaguuacacucuggaaaggauguauuuuuuaugccaccugagaaaugugacacccuucugugugauauuggugaguccucuccaaauccaacuauagaagaaggaagaacguuacguguucuaaaaaugguggaaccauggcucagaggaaaccaauucugcauaaaaauccuaaauccuuacaugccaagugugguagaaacucuggagcgaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggcuuaucauggaucauaugaggucaagccaucaggaucagccucaucuauggugaauggaguggugagauugcucacgaaaccaugggauguuauccccauggucacacaaauagccaugacugacaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucuguacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucaauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacagauggagucugaaggaaucuuuuuacccagcgaauuggaaacccccaaccuagcugagagggcucuugacugguuagaaaaaaauggugccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuucaccagcugaucaugaaggaugggagggaaauaguggugccaugccgcaaccaagaugaacuugugggcagggcuagagugucacaaggcgccggauggagcuugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggauaaaacucauguauccaguugggaagaaguuccauaccuaggaaaaagggaagaucaaugguguggaucccugauaggcuugacagcgagggccaccugggccaccaacauacaaguagccauaaaccaagugagaaggcucauugggaaugagaauuauuuagauuacaugacaucaaugaagagauucaagaaugagagugauuccgaaggagcacucugguaa

SEQ ID NO: 5552 - RNA, 9879 nt, Artificial Sequence
  derived and/or modified CDS sequence (wt) from DENV-1__KJ189359__SS-prME
uccgugaccaugcuccucaugcugcugcccacaguccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguacuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauauggaguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaaggcugucagcagccauuggaaaggcaugggaggagggcguguguggaauucgaucagccacgcgucuugagaacaucauguggaagcagauaucaaaugaauugaaccacauucuacuugagaaugacaugaaauucacagugguuguaggagaugccaacggaauuuuggcccaagggaaaaaaaugauuaggccacaacccauggaacacaaauacucauggaaaagcuggggaaaagccaaaaucauaggagcagacauacaaaauaccaccuucaucaucgacggcccagacaccccagaaugucccgauggccaaagagcauggaacauuugggaaguugaggacuauggguuuggaguuuucacgacaaauauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacggcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccagugaaggagaaggaggagaaucuaguuaggucaauggucucugcagggucaggagaaguggauaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguagggcuauuauuccgcagacuaacauccagagaaguucuucuccucacgauuggacuaagccugguagcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucauuggauuaugcauggaaaacaacggcuauggcacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugauguaccguuggccgggccacuaauagcuggaggcaugcugauagcauguuaugucauauccggaagcucagccgauuuaucauuggagaaagcggcugaaguauccugggaacaagaagcagaacacuccggugccucacacagcauauuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguauuuuuggcagagaaagaaacagagaucaggaguguuaugggacacacccagcccuccggaaguggaaagagcaguucuugauaauggcaucuauagaaucuugcaaagaggacuguugggcaggucccaaguaggagugggagucuuccaagacggcguguuccacacaauguggcacguuaccaggggagcuguccuuauguaccaagggaaaagacuggaaccaagcugggccagugucaaaaaggacuugaucucauauggaggagguuggagguuccaaggaucauggaacacgggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguauuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcaguaaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggagcaaauuuccgggccgauaggguaauagacccaaggcggugcuugaaaccgguaauacuaaaagaugguccagagcgugucauucuagccggaccgaugccggugacuguggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuucaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguucaaagaguucgcagcaggaagaagaagugucucaggugaccuaauauuggaaauagggaaacuuccacaacauuugacgcuaagagcccagaaugcucuggacaacuuggucauguugcacaacuccgaacaaggaggaaaagccuacagacaugcuauggaggaacuaccagacaccauagaaacauugaugcuucuagcuuugauagcuguguugacugguggagugacgcuguucuuccuaucagggaaaggccuagggaaaacaucuauuggcuugcucugugugacggccucaagcgcacuguuauggauggccaguguggagccccauuggauagcggccuccaucauacuagaguucuuuuugauggugcugcucauuccagagccagacagacaacgcacuccacaggacaaccagcuagcauauguggugauagguuuguuauucaugauacugacaguggcagccaaugagaugggauuacuggaaaccacaaagaaagaccuggggauuggcuauguagccgccgaaaaccaccaacauaccacaaugcuggacguagaccuacacccagcuucagccuggacccucuaugcaguagccacaacagucaucacucccaugaugagacacacaauugaaaauacaacggcaaacauuucccugaccgccauugcaaaucaggcagcuauauugaugggacuugacaagggauggccaauaucaaagauagacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguauaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaauaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucaagaggaacagccaaacugaggugguuuguggagaggaaccucgugaaaccagaaggaaaagucauagaccucgguuguggaagagguggcuggucauauuauugugcugggcugaagaaaguuacugaagugaagggauauacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcgaaugcaaagaaaacauggagggaugcuagugcgaaacccacucucaagaaauucuacccaugaaauguauuggguuucauguggaacaggaaacauugugucggcagugaacaugacauccagaauguuacugaaccgauuuacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacgaaaccaugggauguuauccccauggucacacaaauagcuaugacugauaccacacccuucggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacacagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacagauggagucugaaggaaucuuuuuacccagcgaauuggaaacccccaaccuagcugagagggcucuugacugguuagaaaaacauggugccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagcuugagagaaacugcuugccuaggcaagucauaugcacaaauguggcagcugauguacuuccacagaagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggauaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugauuccgaaggagcacucugguaa

SEQ ID NO: 5553 - RNA, 9879 nt, Artificial Sequence
  derived and/or modified CDS sequence (wt) from DENV-1__KJ189360__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguacuggagcacggaagcugcgucaccaccauggcaaaaaauaaaccaacauuggacauugaacucuugaagacggaggucacgaacccugccgucuugcgcaaacuguguauugaagcuaaaauaucaaacaccaccaccgauucaagauguccaacacaaggagaggccacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuugccacugccauggacuucgggggcuucaacaucccaagagaccuggaacagacaagauuugcuggucacauucaagacagcucaugcaaagaaacaggaaguagucguauugggaucacaggaaggagcaaugcauacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagauuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcgugggaggagggcguguguggaauucgaucagccacgcgucuugagaacaucauguggaagcagauaucaaaugaauugaaccacauuuuacuugagaaugacaugaaauucacagugguuguaggagaugccaacggaauuuuggcccaaggaaaaaaaaugauuaggccacaacccauggaacacaaauacucauggaaaagcuggggaaaagcuaaaaucauaggagcagacauacaaaauaccaccuucauuaucgacggcccagacaccccagaauguccugauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaaaacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccagugaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcugucuuccuccuucuuauaaugggacaacugacauggaaugaucugauuagguuaugcaucauggucggagcuaacgcuucagacaggauggggaugggaacaacguaccuagccuugauggcuacuuucaaaaugagaccaauguucgcuguagggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucauuggauuaugcauggaaaacaacggcuauggcacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccauuaauagcuggaggcaugcuaauagcauguuaugucauauccgguagcucagccgauuuaucauuggagaaagcggcugaaguauccugggaacaagaagcagaacacuccggugccucacacagcauauuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugauaauggcaucuauagaaucuugcaaagaggauuguugggcaggucccaaguaggagugggaguuuuccaagacggcguguuccacacaauguggcacguuaccaggggagcuguccuuauguaccaagggaagagacuggaaccaagcugggccagugugaaaaaggacuugaucucauauggaggagguuggagguuccaaggaucauggaacacgggagaagaagugcagguaauagcuguugaaccaggaaaaaaccccaaaaauguacagacaacgccgggcaccuucaagacuccugaaggcgaaguuggagccauagcucuagauuucaaacccggcacaucuggaucucccaucgugaacagagagggaaaaauagugggucuguauggaaauggaguggugacaacaaguggaaccuacgucagugccauugcccaagcuaaagcaucacaggaagggccucuaccagagauugaggacgagguauuuaagaaaagaaacuuaacaauaauggaccugcacccaggaucagggaaaacaagaagauaucuuccagccauaguccgugaggccauaaaaaggaaacugcguacguuaauccuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacugcggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccugauauuggaaauagggaaacuuccacaacauuugacguuaagagcccagaaugcucuggacaacuuggucauguugcacaauuccgaacaaggaggaaaagccuacagacaugcuauggaggaacuaccagacaccauagaaacauugaugcuacuagcuuugauagcuguguugacugguggagugacgcuguucuuccuaucaggaaaaggccuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugccacaaugcuggacguagaccuacacccagcuucagccuggacccucuaugcaguagccacaacagucaucacucccaugaugagacacacaauugaaaauacaacggcaaacauuucccugaccgccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcccaaaaaaggacagcagccggaauaaugaaaaauccaaccguagacgggauuguugcaauagacuuggauccugugguuuaugaugcaaaauuugaaaaacaacuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaauauuuucaggggaaguuaucuagcaggagcaggucuggcuuucucauugaugaaaucuuuaggaggagguaggagaggcacgggagcucaaggggaaacacugggagagaaauggaaaagacaguugaaccaacugagcaagucagaauucaacaccuacaaaaggagugggauuauggagguggacagauccgaagccaaagagggacugaaaagaggagaaacaaccaaacaugcagugucaagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaaacuacacucuggaaaggauguauuuuuuaugccaccugagaaaugugacacucuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcgaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagaaaauauaaaaaaugaacacaagucaacauggcauuaugaugaggacaauccauacaaaacaugggccuaucauggaucauaugaggucaagccaucaggaucagccucaucuauggugaauggaguggugagauugcucacgaaaccaugggaugucauccccauggucacacaaauagcuaugacugauaccacacccuucggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuuuaugaaugaagaucacugguuuaguagagagaauucacucaguggaguggaaggagaaggacugcacaaacuuggauacauacucagagacauaucaaagauuccggggggaaauauguacgcagaugauacagccggaugggacacaagaguaacagaggaugaccuccagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagagggaguggacaggucggaacuuauggcuuaaauacuuucaccaauauggagguccaacuaauaagacaaauggagucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaaggaaagacauaccgcagugggaaccuucaaaaggauggaaugauuggcagcaagugccuuuuuguucacaccauuuccaccaacugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggagaacaaaacucacguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuauuuagauuacaugacaucgaugaagagauucaagaaugagagugauuccgaaggagcacucugguaa

SEQ ID NO: 5554 - RNA, 9879 nt, Artificial Sequence
  derived and/or modified CDS sequence (wt) from DENV-1__KJ189361__SS-prME
uccgugaccaugcuccucaugcugcugcccacagccauggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagcuuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguacuggagcacggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggccacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuugccacugccauggacuucgggggcuucaacaucccaagagaccuggaacagacaagauuugcuggucacauucaagacagcucaugcaaagaaacaggaaguagucguauugggaucacaggaaggagcaaugcauacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagauuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcgugggaggagggcguguguggaauucgaucagccacgcgucuugagaacaucauguggaagcagauaucaaaugaauugaaccacauuuuacuugagaaugacaugaaauucacagugguuguaggagaugccaacggaauuuuggcccaagggaaaaaaaugauuaggccacaacccauggaacacaaauacucauggaaaagcuggggaaaagcuaaaaucauaggagcagacauacaaaauaccaccuucauuaucgacggcccagacaccccagaauguccugauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaaaacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaaggcaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccagugaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcugucuuccuccuucuuauaaugggacaacugacauggaaugaucugauuagguuaugcaucauggucggagcuaacgcuucagacaggauggggaugggaacaacguaccuagccuugauggcuacuuucaaaaugagaccaauguucgcuguagggcuauuauuccgcagacuaacauccagagaaguucuucuccucacgauuggauuaagccugguggcauccguggagcuaccaaauuccuuggaggagcuaggggauggacuugcaauggguaucaugauguuaaaauuguugacugaauuucagccacaccaguuauggaccaccuuauugucucugacauuugucaaaacaacucucucauuggauuaugcauggaaaacaacggcuauggcacugucuaucguaucucucuuuccuuuaugccugucuacgaccucccaaaaaacaacauggcuuccggugcuguuaggaucuuuuggaugcaaaccauuaaccauguuucucauaacagaaaacaaaaucuggggaaggaaaaguuggccccucaaugaaggaauuauggcuauuggaauagucagcauucuacuaagcucacuccucaaaaaugaugugccguuggccgggccauuaauagcuggaggcaugcuaauagcauguuaugucauauccgguagcucagccgauuuaucauuggagaaagcggcugaaguauccugggaacaagaagcagaacacuccggugccucacacagcauauuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugauaauggcaucuauagaaucuugcaaagaggauuguugggcaggucccaaguaggagugggaguuuuccaagacggcguguuccacacaauguggcacguuaccaggggagcuguccuuauguaccaagggaagagacuggaaccaagcugggccagugugaaaaaggacuugaucucauauggaggagguuggagguuccaaggaucauggaacacgggagaagaagugcagguaauagcuguugaaccaggaaaaaaccccaaaaauguacagacaacgccgggcaccuucaagacuccugaaggcgaaguuggagccauagcucuagauuucaaacccggcacaucuggaucucccaucgugaacagagagggaaaaauagugggucuguauggaaauggaguggugacaacaaguggaaccuacgucagugccauugcccaagcuaaagcaucacaggaagggccucuaccagagauugaggacgagguauuuaagaaaagaaacuuaacaauaauggaccugcacccaggaucagggaaaacaagaagauaucuuccagccauaguccgugaggccauaaaaaggaaacugcguacguuaauccuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuaguauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacugcggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccuuuuugagccagagagagagaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguucaaagaguucgcagcaggaagaagaagugucucaggugaccugauauuggaaauagggaaacuuccacaacauuugacguuaagagcccagaaugcucuggacaacuuggucauguugcacaauuccgaacaaggaggaaaagccuacagacaugcuauggaggaacuaccagacaccauagaaacauugaugcuacuagcuuugauagcuguguugacugguggagugacgcuguucuuccuaucaggaaaaggccuagggaaaacauccauuggcuugcucugugugacggccucaagcgcacuguuauggauggccaguguggagccccauuggauagcggccuccaucauacuagaguucuuuuugauggugcugcucauuccagagccagacagacagcguacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugccacaaugcuggacguagaccuacacccagcuucagccuggacccucuaugcaguagccacaacagucaucacucccaugaugagacacacaauugaaaauacaacggcaaacauuucccugaccgccauugcaaaucaggcagcuauauugaugggacuugacaagggauggccaauaucgaagauggacauaggaguuccacuucucgccuuagggugcuauucucaggugaacccauugacacugacagcggcgguguugauguuaguggcucauuaugccauaauuggaccaggacugcaagcaaaggccacuagagaagcccaaaaaaggacagcagccggaauaaugaaaaauccaaccguagacgggauuguugcaauagacuuggauccugugguuuaugaugcaaaauuugaaaaacaacuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaauauuuucaggggaaguuaucuagcaggagcaggucuggcuuucucauugaugaaaucuuuaggaggagguaggagaggcacgggagcucaaggggaaacacugggagagaaauggaaaagacaguugaaccaacugagcaagucagaauucaacaccuacaaaaggagugggauuauggagguggacagauccgaagccaaagagggacugaaaagaggagaaacaaccaaacaugcagugucaagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaaacuacacucuggaaaggauguauuuuuuaugccaccugagaaaugugacacucuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcgaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagaaaauauaaaaaaugaacacaagucaacauggcauuaugaugaggacaauccauacaaaacaugggccuaucauggaucauaugaggucaagccaucaggaucagccucaucuauggugaauggaguggugagauugcucacgaaaccaugggaugucauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuuuaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaguaacagaggaugaccuccagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagagggaguggacaggucggaacuuauggcuuaaauacuuucaccaauauggagguccaacuaauaagacaaauggagucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaaggaaagacauaccgcagugggaaccuucaaaaggauggaaugauuggcagcaagugccuuuuugcucacaccauuuccaccaacugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccugggaaaaagggaagaucaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugauuccgaaggagcacucugguaa

SEQ ID NO: 5555 - RNA, 9879 nt, Artificial Sequence
  derived and/or modified CDS sequence (wt) from DENV-1__KJ189362__SS-prME
uccgugaccaugcuccucaugcugcuucccacagcccuggcguuucauuugaccacacgagggggagagccacacaugauaguuaguaagcaggagagaggaaagucacucuuguuuaagaccucugcgggcgucaauaugugcacccucauugcgauggacuugggagaguuaugugaggacacaaugaccuacaaaugcccccggaucacugaggcagaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguacuggagcauggaagcugugucaccaccauggcaaaaaauaaaccaacauuggacauugaacucuugaagacagaggucacgaacccugcugucuugcgcaaacugugcauugaagcuaaaauaucaaacaccaccaccgauucaagauguccaacacaaggagaggcuacacugguggaagaacaagacgcgaacuuugugugucgccgaacgcuuguggacagaggcugggguaauggcugcggacuauucggaaagggaagucuauugacgugugccaaguucaagugugugacaaaacuagaaggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggggcccucacauuggacugcucaccuagaacagggcuggacuuuaacgagauggugcuauugacaaugaaagaaaaaucauggcuuguccacaaacaaugguuucuagacuugccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggaaugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguucacaucugugggaaaauugguacaccagauuuuuggaaccgcauaugggguucuguucagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacucuccaaaaagacugucagcagccauuggaaaggcgugggaggagggcguguguggaauucgaucagccacgcgucuugagaacaucauguggaagcagauaucaaaugaauugaaccacauuuuacuugagaaugacaugaaauucacagugguuguaggagaugccaacggaaucuuggcccaaggaaaaaaaaugauuaggccacaacccauggaacacaaauacucauggaaaagcuggggaaaagcuaaaaucauaggagcagacauacaaaacaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacauguaccuggccgaaaucucacacucuauggagcaauggaguuuuggaaagugaaaugauaaucccaaagauauauggaggaccaauaucucagcacaacuacagaccaggguauuucacacaaacagcagggccauggcaccuggguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacgcuucagaggagaagacggguguugguauggcauggaaaucagaccagugaaggagaaggaggagaaucuaguuaggucaauggucucugcaggaucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucauggucggagcuaacgcuucagacaggauggggaugggaacaacguaccuagccuugauggcuacuuucaaaaugagaccaauguucgcuguagggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuguggaccaccuuauugucucugacauuugucagaacaacucucucauuggauuaugcauggaaaacaacggcuauggcacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccgguagcucagccgauuuaucauuggagaaagcggcugaaguguccugggaacaagaagcagaacauuccggugccucacacagcauauuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugauaauggcaucuauagaaucuugcaaagaggauuguugggcaggucccaaguaggagugggaguuuuccaagacggcguguuccacacaauguggcacguuaccaggggagcuguccuuauguaccaagggaagagacuggaaccaagcugggccaguguaaaaaaggacuugaucucauauggaggagguuggagguuccaaggaucauggaacacgggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguauuuaagaaaagaaacuuaacaauaauggaccugcacccaggaucagggaaaacaagaagauaucuuccagccauaguccgugaggccauaaaaaggaaacugcguacguuaauccuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacugcggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcuuaugagaagaggagaucuaccaguuuggcuauccuacaaaguagccucagaagguuuccaguacuccgacagaagguggugcuuugauggggagaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauacuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuacuagcuuugauagcuguguugacugguggagugacgcuguucuuccuaucaggaaaaggccuagggaaaacauccauuggcuugcucugugugacggccucaagcguacuguuauggauggccaguguggagccccauuggauagcggccuccaucauacuagaguucuuuuugauggugcugcucauuccagagccagacagacagcgcacuccacaggacaaccagcuagcauauguggugauaggcuuguuauucaugauacugacaguggcagccaaugagaugggauuauuggaaaccacaaagaaagaccuggggauuggcuauguagccgccgaaaaccaccaacaugccacaaugcuggacguagaccuacacccagcuucagccuggacccucuaugcaguagccacaacagucaucacucccaugaugagacauacaauugaaaauacaacggcaaacauuucccuaaccgccauugcaaaucaggcagcuauauugaugggacuugacaagggauggccaauaucgaagauggacauaggaguuccacuucucgccuuagggugcuauucucaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaacuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaauauuuucaggggaaguuaucuagcaggagcaggucuggcuuucucauuaaugaaaucuuuaggaggagguaggagaggcacgggagcucaaggggaaacacugggagagaaauggaaaagacaguugaaccaacugagcaagucagaauucaacaccuacaaaaggagugggauuauggagguggacagauccgaagccaaagagggacugaaaagaggagaaacaaccaaacaugcagugucaagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaagaaccuaucccaauggcgaccuauggauggaaccuaguaaaacuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaaucuuaaauccuuacaugccaagugugguagaaacucuagagcgaaugcaaagaaaacauggagggaugcuagugcgaaacccacucucaagaaauucuacccaugaaauguauuggguuucauguggaacgggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagacaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacgaaaccaugggaugucauccccauggucacacaaauagcuaugacugauaccacacccuuuggacaacagagaguguuuaaagagaaaguugacacgcguacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagauuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagacgauacagccggaugggacacaagaguaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaacauggagguccaacuaauaagacaaauggagucugaaggaaucuuuuuacccagcgaauuggaaacccccaaccuagcugagagggcucuugacugguuagaaaaacauggugccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccaacugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggagaacaaaacucauguauccaguugggaagaaguuccauaccuaggaaaaagggaagaucaaugguguggaucccugauaggcuugacagcgagggccaccugggccaccaacauacaaguagcuauaaaccaagugagaaggcucaucgggaaugagaauuauuuagauuacaugacaucaaugaagagauucaagaaugagagugauuccgaaggagcacucugguaa

SEQ ID NO: 5556 - RNA, 9879 nt, Artificial Sequence
  derived and/or modified CDS sequence (wt) from DENV-1__KJ189363__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggauuacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucauggugauagccuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguacuggagcacggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggccacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuugccacugccauggacuucgggggcuucaacaucccaagagaccuggaacagacaagauuugcuggucacauucaagacagcucaugcaaagaaacaggaaguagucguauugggaucacaggaaggagcaaugcauacugcguugacuggggcgacagaaauccagacgucaggaacgacaacaaucuucgcaggacaccugaaaugcagacuaaaaauggauaaacugaccuuaaaagggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacauugugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagauuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugagguccacacuuggacagagcaauacaaauuccaggcugacuccccaaaaagacugucagcagccauuggaaaggcgugggaggagggcguguguggaauucgaucagccacgcgucuugagaacaucauguggaagcagauaucaaaugaauugaaccacauuuuacuugagaaugacaugaaauucacagugguuguaggagaugccaacggaauuuuggcccaagggaaaaaaaugauuaggccacaacccauggaacacaaauacucauggaaaagcuggggaaaagcuaaaaucauaggagcagacauacaaaauaccaccuucauuauugacggcccagacaccccagaauguccugauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaaaacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaaggcaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccagugaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcugucuuccuccuucuuauaaugggacaacugacauggaaugaucugauuagguuaugcaucauggucggagcuaacgcuucagacaggauggggaugggaacaacguaccuagccuugauggcuacuuucaaaaugagaccaauguucgcuguagggcuauuauuccgcagacuaacauccagagaaguucuucuccucacgauuggauuaagccugguggcauccguggagcuaccaaauuccuuggaggagcuaggggauggacuugcaauggguaucaugauguuaaaauuguugacugaauuucagccacaccaguuauggaccaccuuauugucucugacauuugucaaaacaacucucucauuggauuaugcauggaaaacaacggcuauggcacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccauuaauagcuggaggcaugcuaauagcauguuaugucauauccgguagcucagccgauuuaucauuggagaaagcggcugaaguauccugggaacaagaagcagaacacuccggugccucacacagcauauuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugauaauggcaucuauagaaucuugcaaagaggauuguugggcaggucccaaguaggagugggaguuuuccaagacggcguguuccacacaauguggcacguuaccaggggagcuguccuuauguaccaagggaagagacuggaaccaagcugggccagugugaaaaaggacuugaucucauauggaggagguuggagguuccaaggaucauggaacacgggagaagaagugcagguaauagcuguugaaccaggaaaaaaccccaaaaauguacagacaacgccgggcaccuucaagacuccugaaggcgaaguuggagccauagcucuagauuucaaacccggcacaucuggaucucccaucgugaacagagagggaaaaauagugggucuguauggaaauggaguggugacaacaaguggaaccuacgucagugccauugcccaagcuaaagcaucacaggaagggccucuaccagagauugaggacgagguauuuaagaaaagaaacuuaacaauaauggaccugcacccaggaucagggaaaacaagaagauaucuuccagccauaguccgugaggccauaaaaaggaaacugcguacguuaauccuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucagguuacgacuggaucacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacugcggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaagaaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccugauauuggaaauagggaaacuuccacaacauuugacguuaagagcccagaaugcucuggacaacuuggucauguugcacaauuccgaacaaggaggaaaagccuacagacaugcuauggaggaacuaccagacaccauagaaacauugaugcuacuagcuuugauagcuguguugacugguggagugacgcuguucuuccuaucaggaaaaggccuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugccacaaugcuggacguagaccuacacccagcuucagccuggacccucuaugcaguagccacaacagucauuacucccaugaugagacacacaauugaaaauacaacggcaaacauuucccugaccgccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcccaaaaaaggacagcagccggaauaaugaaaaauccaaccguagacgggauuguugcaauagacuuggauccugugguuuaugaugcaaaauuugaaaaacaacuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaauauuuucaggggaaguuaucuagcaggagcaggucuggcuuucucauugaugaaaucuuuaggaggagguaggagaggcacgggagcucaaggggaaacacugggagagaaauggaaaagacaguugaaccaacugagcaagucagaauucaacaccuacaaaaggagugggauuauggagguggacagauccgaagccaaagagggacugaaaagaggagaaacaaccaaacaugcagugucaagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaaacuacacucuggaaaggauguauuuuuuaugccaccugagaaaugugacacucuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcgaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagaaaacauaaaaaaugaacacaagucaacauggcauuaugaugaggacaauccauacaaaacaugggccuaucauggaucauaugaggucaagccaucaggaucagccucaucuauggugaauggaguggugagauugcucacgaaaccaugggaugucauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguuugaagcccuugguuuuaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaguaacagaggaugaccuccagaaugaggcuaaaaucacugauaucauggagccugaacaugcucuauuggcuacgucaauuuuuaagcugacuuaucaaaacaagguggugagggugcaaagaccagcaaaaaauggaaccgugauggauguuauauccagacgugaucagagagggaguggacaggucggaacuuauggcuuaaauacuuucaccaauauggagguccaacuaauaagacaaauggagucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaaggaaagacauaccgcagugggaaccuucaaaaggauggaaugauuggcagcaagugccuuuuuguucacaccauuuccaccaacugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggagaacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugauuccgaaggagcacucugguaa

SEQ ID NO: 5557 - RNA, 9879 nt, Artificial Sequence
  derived and/or modified CDS sequence (wt) from DENV-1__KJ189364__SS-prME
uccgugaccaugcuccucaugcugcuucccacagcccuggcguuucauuugaccacacgagggggagagccacacaugauaguuaguaagcaggagagaggaaagucacucuuguuuaagaccucugcgggcgucaauaugugcacccucauugcgauggacuugggagaguuaugugaggacacaaugaccuacaaaugcccccggaucacugaggcagaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguacuggagcauggaagcugugucaccaccauggcaaaaaauaaaccaacauuggacauugaacucuugaagacagaggucacgaacccugcugucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggggcccucacauuggacugcucaccuagaacagggcuggacuuuaacgagauggugcuauugacaaugaaagaaaaaucauggcuuguccacaaacaaugguuucuagacuugccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggaaugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguucacaucugugggaaaauugguacaccagauuuuuggaaccgcauaugggguucuguucagcggugucucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacucuccaaaaagacugucagcagccauuggaaaggcgugggaggagggcguguguggaauucgaucagccacgcgucuugagaacaucauguggaagcagauaucaaaugaauugaaccacauuuuacuugagaaugacaugaaauucacagugguuguaggagaugccaacggaaucuuggcccaaggaaaaaaaaugauuaggccacaacccauggaacacaaauacucauggaaaagcuggggaaaagcuaaaaucauaggagcagacauacaaaacaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacauguaccuggccgaaaucucacacucuauggagcaauggaguuuuggaaagugaaaugauaaucccaaagauauauggaggaccaauaucucagcacaacuacagaccaggguauuucacacaaacagcagggccauggcaccuggguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacgcuucagaggagaagacggguguugguauggcauggaaaucagaccagugaaggagaaggaggagaaucuaguuaggucaauggucucugcaggaucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucauggucggagcuaacgcuucagacaggauggggaugggaacaacguaccuagccuugauggcuacuuucaaaaugagaccaauguucgcuguagggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucagaacaacucucucauuggauuaugcauggaaaacaacggcuauggcacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccgguagcucagccgauuuaucauuggagaaagcggcugaaguguccugggaacaagaagcagaacauuccggugccucacacagcauauuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugauaauggcaucuauagaaucuugcaaagaggauuguugggcaggucccaaguaggagugggaguuuuccaagacggcguguuccacacaauguggcacguuaccaggggagcuguccuuauguaccaagggaagagacuggaaccaagcugggccaguguaaaaaaggacuugaucucauauggaggagguuggagguuccaaggaucauggaacacgggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguauuuaagaaaagaaacuuaacaauaauggaccugcacccaggaucagggaaaacaagaagauaucuuccagccauaguccgugaggccauaaaaaggaaacugcguacguuaauccuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacugcggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcuuaugagaagaggagaucuaccaguuuggcuauccuacaaaguagccucagaagguuuccaguacuccgacagaagguggugcuuugauggggagaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauacuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacacugaugcuacuagcuuugauagcuguguugacugguggagugacgcuguucuuccugucaggaaaaggccuagggaaaacaucuauuggcuugcucugugugacggccucaagcgcacuguuauggauggccaguguggagccccauuggauagcggcuuccaucauacuagaguucuuuuugauggugcugcucauuccagagccagacagacagcgcacuccacaggacaaccagcuagcauauguggugauaggcuuguuauucaugauacugacaguggcagccaaugagaugggauuauuggaaaccacaaagaaagaccuggggauuggcuauguagccgccgaaaaccaccaacaugccacaaugcuggacguagaccuacacccagcuucagccuggacccucuaugcaguagccacaacagucaucacucccaugaugagacauacaauugaaaauacaacggcaaacauuucccuaaccgccauugcaaaucaggcagcuauauugaugggacuugacaagggauggccaauaucgaagauggacauaggaguuccacuucucgccuuagggugcuauucucaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaacuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaauauuuucaggggaaguuaucuagcaggagcaggucuggcuuucucauuaaugaaaucuuuaggaggagguaggagaggcacgggagcucaaggggaaacacugggagagaaauggaaaagacaguugaaccaacugagcaagucagaauucaacaccuacaaaaggagugggauuauggagguggacagauccgaagccaaagagggacugaaaagaggagaaacaaccaaacaugcagugucaagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaagaaccuaucccaauggcgaccuauggauggaaccuaguaaaacuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaaucuuaaauccuuacaugccaagugugguagaaacucuggagcgaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagacaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacgaaaccaugggaugucauccccauggucacacaaauagcuaugacugauaccacacccuuuggacaacagagaguguuuaaagagaaaguugacacgcguacaccaagagcaaaacgaggcacaacacagauuauggaggugacagccaagugguuauggaguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagauuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagacgauacagccggaugggacacaagaguaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaacauggagguccaacuaauaagacaaauggagucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccaacugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggagaacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugauuccgaaggagcacucugguaa

SEQ ID NO: 5558 - RNA, 9879 nt, Artificial Sequence
  derived and/or modified CDS sequence (wt) from DENV-1__KJ189365__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguacuggagcacggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggccacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuugccacugccauggacuucgggggcuucaacaucccaagagaccuggaacagacaagauuugcuggucacauucaagacagcucaugcaaagaaacaggaaguagucguauugggaucacaggaaggagcaaugcauacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagauuuuuggaaccgcauaugggguucuguuuagcgguguuucuuggaccaugaaaauaggaauagggauucugcugacaugguugggauuaaauucaaggagcacgucacuuucgaugacgugcauuguaguuggcauggucacacuguaccuaggagucaugguucaagcggauucgggaugugugaucaacuggaagggcagagaacuuaaaugcggaaguggcauuuuugucacuaaugaaguccacacuuggacagagcaauacaaauuccaggcugacuccccaaaaagacugucagcagccauuggaaaggcgugggaggagggcguguguggaauucgaucagccacgcgucuugagaacaucauguggaagcagauaucaaaugaauugaaccacauuuuacuugagaaugacaugaaauucacagugguuguaggagaugccaacggaauuuuggcccaaggaaaaaaaaugauuaggccacaacccauggaacacaaauacucauggaaaagcuggggaaaagcuaaaaucauaggagcagacauacaaaauaccaccuucauuaucgacggcccagacaccccagaauguccugauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaaguuggcgagagccuccuucauagaagucaaaacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaaggcaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccagugaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcugucuuccuccuucuuauaaugggacaacugacauggaaugaucugauuagguuaugcaucauggucggagcuaacgcuucagacaggauggggaugggaacaacguaccuagccuugauggcuacuuucaaaaugagaccaauguucgcuguagggcuauuauuccgcagacuaacauccagagaaguucuucuccuaacgauuggauuaagccugguggcauccguggagcuaccaaauuccuuggaggagcuaggggauggacuugcaauggguaucaugauguuaaaauuguugacugaauuucagccacaccaguuauggaccaccuuauugucucugacauuugucaaaacaacucucucauuggauuaugcauggaaaacaacggcuauggcacugucuaucguaucucucuuuccuuuaugccugucuacgaccucccaaaaaacaacauggcuuccggugcuguuaggaucuuuuggaugcaaaccauuaaccauguuucuuauaacagaaaauaaaaucuggggaaggaaaaguuggccccucaaugaaggaauuauggcuauuggaauagucagcauucuacuaagcucacuccucaaaaaugaugugccguuggccgggccauuaauagcuggaggcaugcuaauagcauguuaugucauauccgguagcucagccgauuuaucauuggagaaagcggcugaaguauccugggaacaagaagcagaacacuccggugccucacacagcauauuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugauaauggcaucuauagaaucuugcaaagaggauuguugggcaggucccaaguaggagugggaguuuuccaagacggcguguuccacacaauguggcacguuaccaggggagcuguccuuauguaccaagggaagagacuggaaccaagcugggccagugugaaaaaggacuugaucucauauggaggagguuggagguuccaaggaucauggaacacgggagaagaagugcagguaauagcuguugaaccaggaaaaaaccccaaaaauguacagacaacgccgggcaccuuuaagacuccugaaggcgaaguuggagccauagcucuagauuucaaacccggcacaucuggaucucccaucgugaacagagagggaaaaauagugggucuguauggaaauggaguggugacaacaaguggaaccuacgucagugccauugcccaagcuaaagcaucacaggaagggccucuaccagagauugaggacgagguauuuaagaaaagaaacuuaacaauaauggaccugcacccaggaucagggaaaacaagaagauaucuuccagccauaguccgugaggccauaaaaaggaaacugcguacguuaauccuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugaucauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacugcggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccugauauuggaaauagggaaacuuccacaacauuugacguuaagagcccagaaugcucuggacaacuuggucauguugcacaauuccgaacaaggaggaaaagccuacagacaugccauggaggaacuaccagacaccauagaaacauugaugcuacuagcuuugauagcuguguugacugguggagugacgcuguucuuccuaucaggaaaaggccuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugccacaaugcuggacguagaccuacacccagcuucagccuggacccucuaugcaguagccacaacagucaucacucccaugaugagacacacaauugaaaauacaacggcaaacauuucccugaccgccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcccaaaaaaggacagcagccggaauaaugaaaaauccaaccguagacgggauuguugcaauagacuuggauccugugguuuaugaugcaaaauuugaaaaacaacuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaauauuuucaggggaaguuaucuagcaggagcaggucuggcuuucucauugaugaaaucuuuaggaggagguaggagaggcacgggagcucaaggggaaacacugggagagaaauggaaaagacaguugaaccaacugagcaagucagaauucaacaccuacaaaaggagugggauuauggagguggacagauccgaagccaaagagggacugaaaagaggagaaacaaccaaacaugcagugucaagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaaacuacacucuggaaaggauguauuuuuuaugccaccugagaaaugugacacucuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcgaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagaaaauauaaaaaaugaacacaagucaacauggcauuaugaugaggacaauccauacaaaacaugggccuaucauggaucauaugaggucaagccaucaggaucagccucaucuauggugaauggaguggugagauugcucacgaaaccaugggaugucauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuuuaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaguaacagaggaugaccuccagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagagggaguggacaggucggaacuuauggcuuaaauacuuucaccaauauggagguccaacuaauaagacaaauggagucugagggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaaggaaagacauaccgcagugggaaccuucaaaaggauggaaugauuggcagcaagugccuuuuuguucacaccauuuccaccaacugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagacgaaaacccauggauggagaacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugauuccgaaggagcacucugguaa

SEQ ID NO: 5559 - RNA, 9879 nt, Artificial Sequence
  derived and/or modified CDS sequence (wt) from DENV-1__KJ189366__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucgcugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacgguaauagccuuuuuuuuagcacaugcuauuggaacauccaucacucagaaagggaucauuuucaucuugcugaugcuggugacaccaucaauggccaugcgaugcgugggaauaggcaacagagacuucguugaaggacugucaggagcaacguggguggacgugguacuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggagcucucacauuggacugcucaccuagaacagggcuggacuuuaaugagauggugcuauugacaaugaaagaaaaaucauggcuuguccacaaacaaugguuucuagacuugccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaauguagacuaaaaauggacaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguucacaucugugggaaaauugguacaccagauuuuuggaaccgcauaugggguucuguuuagcggaguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaaaggcagagaacuuaaauguggaaguggcauuuuugucacuaaugaaguccacacuuggacagagcaauacaaauuccaggcugacuccccaaaaagacugucagcagccauuggaaaggcgugggaggagggcguguguggaauucgaucagccacgcgccuugagaacaucauguggaagcagauaucaaaugaauugaaccacauuuuacuugagaaugacaugaaauucacagugguuguaggagaugccaacggaauuuuggcccaagggaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgagacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuuuacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccagugaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggccguuuuccuccuucuuauaaugggacaacugacauggaaugaucugauuagguuaugcaucaugguuggagcuaacgcuucagacaggauggggaugggaacaacguaccuagccuugauggcuacuuucaaaaugagaccaauguucgcuguagggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucauuagauuaugcauggaaaacaacggcuauggcacugucuauuguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauuuuauuaagcucacuccucaaaaaugaugugccguuggccgggccacuaauagcuggaggcaugcuaauagcauguuaugucauaucugguagcucagccgauuuaucauuggagaaagcggcugaaguauccugggaacaagaagcagaacacuccggugccucacacagcauauuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguauuuuuggcagaaaaagaaacagagaucaggaguauuaugggacacacccagcccuccggaaguggaaagagcaguucuugauaauggcaucuauagaaucuugcaaagaggauuguugggcaggucccaaguaggagugggaguuuuccaagacggcguguuccacacaauguggcacguuaccaggggagcuguccuuauguaccaagggaagagacuggaaccaagcugggccaguguaaaaaaggacuugaucucauauggaggagguuggagguuccaaggaucauggaacacgggagaagaagugcaggugauagcuguugaaccaggaaaaaacccuaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguauuuaagaaaagaaacuuaacaauaauggaccugcacccaggaucagggaaaacaagaagauaucuuccagccauaguccgugaggccauaaaaaggaaauugcguacguuaauccuggcucccacaagaguugucgccucugaaauggcagaggcacucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcucauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacagugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacugcggccagugcugcccagaggagaggaagaauuggaaggaaccaaaacaaggaaggugaucaguauguuuauaugggacagccuuuaaauaaugaugaagaucacgcucauuggacagaagcuaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggagaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggauaacuuggucauguugcacaauuccgaacaaggaggaaaagccuacagacaugcuauggaggaacuaccagacaccauagaaacauugaugcuacuagcuuugauagcuguguugacugguggagugacgcuguucuuccuaucaggaaaaggccuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugucacaaugcuggacguagaccuacacccagcuucagccuggacccucuaugcaguagccacaacagucaucacucccaugaugagacacacaauugaaaaugcaacggcaaacauuucccugaccgccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcccauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaacuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaauauuuucaggggaaguuaucuagcaggagcaggucuggcuuucucauuaaugaaaucuuuaggaggagguaggagaggcacgggagcucaaggggaaacacugggagagaaauggaaaagacaguugaaccaacugagcaagucagaauucaacaccuacaaaaggagugggauuauggagguggacagauccgaagccaaagagggacugaaaagaggagaaacaaccaaacaugcagugucaagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuacggauggaaccuaguaaaacuacacucuggaaaggauguauuuuuuaugccaccugagaaaugugacacccuucugugugauauuggugaguccucuccgaauccaacuguagaagaaggaagaacguuacguguucuaaaaaugguggaaccauggcucagaggaaaccaauucugcauaaaaauccuaaauccuuacaugccaagugugguagaaacucuggagcgaaugcaaagaaaacauggagggaugcuagugcgaaacccacucucaagaaauuccacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagcuaaccuagauaucauuggccagaggauagagaauauaaaaaaugaacacaagucaacauggcauuaugaugaggacaauccauacaaaacaugggccuaucauggaucauaugaggucaagccaucaggaucagccucauccauggugaauggaguggugagauugcucacgaaaccaugggaugucauccccauggucacacaaauagcuaugacugauaccacacccuucggacaacagagaguguuuaaagagaaaguugacacgcgcacaccaagagcaaagcgaggcacaacacagauuauggaggugacagccaagugguuaugggguuuccuuuccagaaacaaaaaacccagaaucugcacaagagaggaguucacaagaaagguuaggucaaacgcggcaguaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuuggcuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaguaacagaggaugaucuucagaaugaggcuaaaaucacugacaucauggagccugaacaugcucuauuggccacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaacauggagguccaacuaauaagacaaauggagucugaaggaaucuuuuuacccagcgaauuggaaacccccaaccuagcugagagggcucuugacugguuagaaaaacauggcgccgaaaggcucaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcaacaagugccuuuuuguucacaccauuuccaccaacugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuucacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggagaacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugauuccgaaggagcacucugguaa

SEQ ID NO: 5560 - RNA, 9879 nt, Artificial Sequence
  derived and/or modified CDS sequence (wt) from DENV-1__JN819417__SS-prME
uccgugaccaugcuccucaugcugcugcccacagcccuggcguuccauuugaccacacgagggggagagccacacaugguaguuagcaagcaggaaagaggaaagucacucuuguuuaagaccucugcaggugucaacauguguacucucauugcgauggauuugggagaguuaugugaggacacaaugaccuacaaaugcccccggauuacugaggcggaaccagaugacguugacugcuggugcaaugccacagacacaugggugaccuaugggacauguucucaaaccggcgaacaccgacgagacaaacguucuguggcacuggccccacacgugggacuuggucuagaaacaagaaccgaaacauggauguccucugaaggcgccuggaaacaaauacaaaaaguggagacuugggcuuugagacacccaggauucacggugauagcccuuuuuuuagcacaugccauaggaacauccaucacucagaaagggaucauuuucauuuugcugaugcugguaacaccaucaauggccaugcgaugcgugggaauaggcaacagagacuucguugaaggacugucaggagcgacguggguggacgugguguuggagcacggaagcugcgucacuaccauggcaaaaaacaaaccaacauuggacauugaacucuugaagacggaggucacgaacccugccaucuugcgcaaacugugcauugaagcuaaaauaucaaacaccaccaccgauucaagauguccaacacaaggagaggcuacacugguggaagaacaagacgcgaacuuugugugucgacgaacguuuguggacagaggcuggggcaaugguugcggacuauuuggaaaaggaagccuacugacgugugcuaaguucaagugugugacaaaacuggaaggaaagauaguucaacaugaaaacuuaaaauauucagugauagucacuguccacacuggggaccagcaccaagugggaaacgagacuacagaacauggaacaauugcaacuauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuugccacugccuuggacuucgggggcuucaacaucccaugagacuuggaacagacaagauuugcuggucacguucaagacagcucaugcaaagaaacaggaaguggucguacugggaucacaggaaggagcaaugcacacugcguugacuggggcgacagaaauccagacgucaggaacgacaacaaucuuugcaggacaccugaaaugcagacuaaaaauggauaaacugacuuuaaaagggaugucguaugugaugugcacaggcucauuuaagcuagagaaggaaguggcugagacccagcauggaacuguccuagugcagguuaaauacgaaggaacagacgcgccaugcaagauccccuuuucgacccaagaugagaaaggagugacccagaauggaagguugauaacagccaaucccauaguuacugauaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagauaccgcaugggacuucggcuccauaggaggaguguucacgucugugggaaaauugguacaccagguuuuuggaaccgcauaugggguucuguucagcgguguuucuuggaccaugaaaauaggaauagggauucugcugacaugguugggguugaauucaaggagcacgucacuuucgaugacgugcauugcuguuggcaugguuacacuguaccuaggggucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauugggaaggcaugggaggagggcguauguggaauucgaucagccacgcgucuugagaacaucauguggaagcaaauaucaaaugaauugaaccacauucuacuugaaaaugacaugaaauucacagugguuguaggagaugcuaguggaauuuuggcccagggaaaaaaaaugaucaggccacaacccauggaacacaaauacucauggaaaaguuggggaaaagccaaaaucauaggagcagacacacagaauaccaccuucaucaucgacggccccgauacuccagaaugccccgaugaccaaagagcguggaacauuugggaaguugaggacuauggguuuggaaucuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagcuuccuucauagaagucaagacaugcaucuggccgaaaucucacacucuauggaguaauggagucuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugagcauuguggaaaucgagguccaucucucagaacuacaacagucacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauuaggaauacuaugcguaucaauaaugauugaagaagugaugagauccagauggaguagaaagaugcugaugacuggaacacuagcuguuuuccuccuucuuauaaugggacaacugacauggaaugaucugauuagguuaugcaucaugguuggagcuaaugcuucagacaggauggggaugggaacaacguaccuagccuugauggguacuuucaaaaugagaccaauguucgcuguugggcuauuauuucgcagacuaacauccagagaaguucuucuucucacgauuggauuaagccugguggcauccguggagcuaccaaauucuuuggaggagcuaggggauggacuugcaauggguaucaugauguuaaaauuauugacugaauuucagccacaccagcuauggaccaccuuacugucccugacauuuaucaaaacaacucucucauuggauuaugcauggaagacaauggcuaugguacugucaaucguaucucucuuuccuuuaugucuguccacgaccucccaaaaaacaacauggcuuccggugcuguuaggaucuuuuggaugcaaaccauuaaccauguuucucauaacagaaaacaaaaucuggggaaggaaaaguuggccccucaaugaaggaauuauggcuauuggaauagucaguauucuacuaaguucacuccucaaaaaugaugugcccuuggccggcccacuaauagcuggaggcaugcuaauagcauguuaugucauaucuggaagcucagccgauuuaucauuggagaaagcggcugagauauccugggaagaagaagcagaacacucugguaccucacauaacauauuaguagagguccaagaugauggaacuaugaaaauaaaagaugaagagagggaugacacacucaccauacuccucaaagcaacucugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaauccugcaaagaggacuguugggcaggucccagguaggagugggaguuuuccaagacggcguguuucacacaauguggcacgucaccaggggagcuguccucauguaccaagggaagaggcuggaaccaagcugggccaguguaaaaaaggacuugaucucauauggaggagguuggagguuucaaggaucauggaacacuggagaagaagugcaggugauagcuguugaaccaggaaaaaaccccaaaaauguacagacaacgccggguaccuuuaagacucccgaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaagaagggccucuaccagagauugaggacgagguguuuaagaaaagaaacuuaacaauaauggaccugcauccaggaucaggaaaaacaagaagauaucuuccagccauaguccgugaggccauaaaaaggaaacugcgcacguuaauauuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacccgagugggcaugggugaagcagcugcgauuuuuaugacagccacccccccaggaucgguggaggccuuuccacagagcaaugcaguuauucaagaugaggaaagagacauuccugagagaucauggaacucaggcuacgacuggaucacugauuuuccagguaaaacaaucugguuuguuccaagcauuaaaucaggaaaugacauugccaacuguuuaagaaagaacggaaaacgggugauccaauugagcagaaaaacuuuugacacugaguaccagaaaacaaaaaacaaugacugggacuauguugucacaacagacauuuccgaaaugggggcaaacuuccgggcugacaggguaauagacccaaggcggugcuugaaaccgguaauacuaaaagaugguccagagcgcgucauucuagcaggaccgaugccaguuacuguggccagcgcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaauacagacuacggggagaagcaaggaaaacguucguggagcucaugagaagaggagaucuaccaguuuggcuauccuacaaagucgccucagaagguuuucaguacucugacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaaguaucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugucauggccucaagcgcacuguuauggauggccaauguggagccccauuggauagcggccuccaucauacuggaguucuuucugauggugcugcucauuccagagccagacagacagcgcacuccacaggacaaccagcuagcauauguggugauagguuuguuauucaugauacugacaguggcagccaaugagaugggauuauuggaaacuacaaagaaagaccuggggauuggccauguagccgcugaaaaccaccaccaugcuacaaugcuggacguagaccuacguccagcuucagccuggacccucuaugcaguggccacaacaguuaucacucccaugaugaggcacacaauugaaaauacaacggcaaacauuucccuaacagccauugcaaaucaggcagccauauugaugggacuugauaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaagaggacagcggccggaauaaugaaaaauccaaccguagacgggauuguugcaauagaccuggauccugugguuuaugaugcaaaauuugaaaaacagcuaggccaaauaauguuacugauacuuuguacaucacagauucucuugaugcggaccacaugggccuugugugaauccaucacacuggcuacugggcccuugaccacucucugggagggaucuccaggaaaauucuggaauaccacgauagcaguguccauggcaaacaucuucaggggaaguuaucuagcaggagcaggucuggccuucucauuaaugaaaucucuaggaggagguaggagagguacaggagcucaaggggaaacacugggagagaaauggaaaagacaguuaaaccaacugagcaagucagaauucaacaccuacaaaaggagugggauuauggagguggacagauccgaagccaaagagggauugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaaguuacacucuggaaaagauguauuuuuuacaccaccugagaaaugugauacccuucugugugauauuggugagucaucuccgaauccaacuauagaagaaggaagaacguuacgugucuuaaagaugguggaaccauggcucagaggaaaccaauucugcauaaaaauccuaaauccuuacaugccaagugugguagaaacucuggagcaaaugcaaaggaaacacggagggaugcuagugagaaacccacucucaagaaauuccacccaugaaauguacuggguuucauguggaacgggaaacauugugucggcagugaacaugacauccagaaugcuacugaaucgauucacaauggcucauaggaagccaacauaugaaaaagauguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugaggucaagccaucaggaucagccucaucuauggugaauggcguggugagauugcucacaaaaccaugggauguuauucccauggucacacaaauagcuaugacugauaccacacccuucggacaacagagaguguuuaaagagaaaguugacacgcgcacaccaagagcaaaacgaggcacagcacaaauuauggaggugacagccaagugguuaugggguuuccuuucuagaaacaaaaaaccuagaauuugcacaagagaggaguucacaaaaaagguuaggucaaacgcagcaauaggagcaguguucguugaugaaaaccaauggaacucagcaaaagaagcaguggaagacgaaagguuuugggaucucgugcacagagaaagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuagaguucgaggcccuugguuucaugaaugaagaucacugguucaguagagagaauucacucagcgggguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaaucuuuaagcugaccuaccagaacaagguggugagggugcaaagaccagcuaaaaauggaaacgugauggauguuauauccagacgugaucagagaggaaguggacaggucggaacuuauggcuuaaauacuuucaccaauauggaaguccaacuaauaagacaaauggagucugaaggaaucuuuuuacccagcgaacuggaaaccccaaaucuagcugagagaguucuugacugguuggaaaaacauggcgccgaaaggcugaaaagaauggcgauuagcggagaugauugugugguaaaaccaauugaugacagguucgcaacagcccuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagcuugagagaaacugcuugccuagguaagucauacgcacaaauguggcagcugauguacuuccacaggagagaccugagacuagcggcuaaugcuaucuguucagcugucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgagggggcacucugguaa

SEQ ID NO: 5561 - RNA, 9879 nt, Artificial Sequence
  derived and/or modified CDS sequence (wt) from DENV-1__FJ687426__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcgcaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuacuaacgugugcuaaguucaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagacuuaccacugccuuggaccucgggagcuucaacaucacaagagacuuggaacagacaagauuugcuggugacauuuaagacagcucaugcaaagaagcaggaaguagucguauuaggaucacaagaaggagcaaugcacacugcguugaccggagcgacagaaauucaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacucagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccucucgaugacgugcauugcaguuggccuaguaacacuauaccuaggagucaugguucaggcggauucaggaugcguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuuggcucaaggaaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaggagccucuuucauagaaguuaaaacauguauuuggccaaaaucccacacucuauggagcaauggaguucuggaaagugaaaugauaauuccaaagaucuauggaggaccaauaucucagcauaacuacagaccaggauauuucacacaaacggcagggccguggcaccuaggcaaguuggaacuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacgcuuuccuugcacuaugcauggaagacaauggcuaugguacugucaauuguaucucucuuccccuuaugccuguccacgaccucccagaaaacaacauggcuuccggugcuauugggaucucuuggaugcaaaccauuaaccauguuucuuauagcagaaaacaaaaucuggggaaggaaaaguuggccccucaaugaagggaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaucugaucucauauggaggagguuggaggcuucaaggauccuggaacacgggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaagcgcucaagggaaugccaauaagguaccaaacaacagcagugaagagugaacacacaggaaaagagauaguugaccucaugugucacgccacuuucaccaugcgccuccugucucccgugagaguccccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaaaaccuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggagaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaccuggucauguugcacaacuccgaacaaggaggaagagccuauagacaugcaauggaagaacugccagacaccauagaaacguugaugcuccuagcuuugauagcuguguuaacugguggagugacgcuguucuuccuaucaggaaagggccuagggaaaacaucuaucggccuacucugcgugauggcuucaagcguacugcuauggauggccaguguggagccccauuggauagcggccuccaucauacuggaguucuuccugaugguguugcuuauuccagagccagacagacaacgcacuccgcaggacaaccagcuggcauauguggugauagguuuauuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggucaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuauaccaccugagaaaugugauacccuuuugugugauauuggugaguccucuccaaacccaacuauagaggaaggaagaacgcuacgcguucuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugagggaaucuuuucacccaacgaauuagagaccccaaauuuagccgagagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccguauauccaguugggaagauguuccauaucuaggaaaaagggaagaucaaugguguggaucucugauaggcuuaacagcaagggccaccugggccaccaacauacaaguggccauaaaccaagugagaagacuaauugggaaugagaauuauucagauuacaugacaucaaugaagagauucaagaacgagagugaacccgaaggggcacucugguga

SEQ ID NO: 5562 - RNA, 9879 nt, Artificial Sequence
  derived and/or modified CDS sequence (wt) from DENV-1__FJ687428__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcgcaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuacuaacgugugcuaaguucaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagacuuaccacugccuuggaccucgggagcuucaacaucacaagagacuuggaacagacaagauuugcuggugacauuuaagacagcucaugcaaagaagcaggaaguagucguauuaggaucacaagaaggagcaaugcacacugcguugaccggagcgacagaaauucaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacucagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaagggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccucucgaugacgugcauugcaguuggccuaguaacacuauaccuaggagucaugguucaggcggauucaggaugcguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuuggcucaaggaaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaggagccucuuucauagaaguuaaaacauguauuuggccaaaaucccacacucuauggagcaauggaguucuggaaagugaaaugauaauuccaaagaucuauggaggaccaauaucucagcauaacuacagaccaggauauuucacacaaacggcagggccguggcaccuaggcaaguuggaacuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacgcuuuccuugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuuauagcagaaaacaaaaucuggggaaggaaaaguuggccccucaaugaagggaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcaaaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaucugaucucauauggaggagguuggaggcuucaaggauccuggaacacgggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaagcgcucaagggaaugccaauaagguaccaaacaacagcagugaagagugaacacacaggaaaagagauaguugaccucaugugucacgcuacuuucaccaugcgccuccugucucccgugagaguccccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaaaaccuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggagaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaccuggucauguugcacaacuccgaacaaggaggaagagccuauagacaugcaauggaagaacugccagacaccauagaaacguugaugcuccuagcuuugauagcuguguuaacugguggagugacgcuguucuuccuaucaggaaagggccuagggaaaacaucuaucggccuacucugcgugauggcuucaagcguacugcuauggauggccaguguggagccccauuggauagcggccuccaucauacuggaguucuuccugaugguguugcuuauuccagagccagacagacaacgcacuccgcaggacaaccagcuggcauauguggugauagguuuauuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggucaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuauaccaccugagaaaugugauacccuuuugugugauauuggugaguccucuccaaacccaacuauagaggaaggaagaacgcuacgcguucuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagagcauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugagggaaucuuuucacccaacgaauuagagaccccaaauuuagccgagagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagauauaccacaaugggaaccuucaaaaggauggaaugauuggcaacaagugcccuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccguauauccaguugggaagauguuccauaucuaggaaaaagggaagaucaaugguguggaucucugauaggcuuaacagcaagggccaccugggccaccaacauacaaguggccauaaaccaagugagaagacuaauugggaaugagaauuauucagauuacaugacaucaaugaagagauucaagaacgagagugaacccgaaggggcacucugguga

SEQ ID NO: 5563 - RNA, 9879 nt, Artificial Sequence
  derived and/or modified CDS sequence (wt) from DENV-1__FJ687429__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcgcaugccauaggaacauccaucacccagaaagggauuauuuucauuuuguuaaugcugguaacaccauccauggccaugcgaugcgugggaauaggcagcagggacuucguggaaggacugucaggagcaacuuggauagaugugguacuggaacauggaaguugcaucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuacugacgugugcuaaguucaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagacuuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauucaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacucagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccucucgaugacgugcauugcaguuggccuaguaacacuauaccuaggagucaugguucaggcggauucaggaugcguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuuggcucaagggaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguauuuggccaaaaucccacacucuauggagcaauggaguucuggaaagugaaaugauaauuccaaagaucuauggaggaccaauaucucagcauaacuacagaccaggauauuucacacaaacggcagggccguggcaccuaggcaaguuggaacuggauuuugauuugugugaggguacaacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggcuaugguacugucaauuguaucucucuuccccuuaugccuauccacgaccucccagaaaacaacauggcuuccggugcuauugggaucucuuggaugcaaaccauuaaccauguuucuuauagcagaaaacaaaaucuggggaaggaaaaguuggccccucaaugaagggaucauggcuguuggaauagucagcauccuacuaaguucacuccucaaaaaugaugugccgcuagcugggccacuaauagcuggaggcaugcuaauagcauguuauguuauaucuggaagcucagccgaccuaucauuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaagcgcucaagggaaugccaauaagguaccaaacaacagcagugaagagugaacacacaggaaaagagauaguugaccucaugugucacgccacuuucaccaugcgccuccugucucccgugagaguccccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaaaaccuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggagaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaccuggucauguugcacaacuccgaacaaggaggaagagccuauagacaugcaauggaagaacugccagacaccauagaaacguugaugcuccuagcuuugauagcuguguuaacugguggagugacgcuguucuuccuaucaggaaagggccuagggaaaacaucuaucggccuacucugcguaauggcuucaagcguacugcuauggauggccaguguggagccccauuggauagcggccuccaucauacuggaguucuuccugaugguguugcuuauuccagagccagacagacaacgcacuccgcaggacaaccagcuggcauauguggugauagguuuauuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaucaggcagcuauauugaugggacuugacaaaggauggccaauaucgaagauggacauaggaguuccacuucucgccuuggggugcuauucccaggugaauccacugacgcugacagcggcggugcugaugcuaguggcucauuacgccauaauuggaccuggacugcaagcaaaagccacuagagaagcucaaaaaaggacagcggccggaauaaugaaaaauccaaccauugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuauaccaccugagaaaugugauacccuuuugugugauauuggugaguccucuccaaacccaacuauagaggaaggaagaacgcuacgcguucuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugagggaaucuuuucacccaacgaauuagagaccccaaauuuagccgagagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccguauauccaguugggaagauguuccauaucuaggaaaaagggaagaucaaugguguggaucucugauaggcuuaacagcaagggccaccugggccaccaacauacaaguggccauaaaccaagugagaagacuaauugggaaugagaauuauucagauuacaugacaucaaugaagagauucaagaacgagagugaacccgaaggggcacucugguga

SEQ ID NO: 5564 - RNA, 9879 nt, Artificial Sequence
  derived and/or modified CDS sequence (wt) from DENV-1__FJ850068__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcgcaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuacuaacgugugcuaaguucaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagacuuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauucaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacucagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccucucgaugacgugcauugcaguuggccuaguaacacuauaccuaggagucaugguucaggcggauucaggaugcguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuuggcucaaggaaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaggagccucuuucauagaaguuaaaacauguauuuggccaaaaucccacacucuauggagcaauggaguucuggaaagugaaaugauaauuccaaagaucuauggaggaccaauaucucagcauaacuacagaccaggauauuucacacaaacggcagggccguggcaccuaggcaaguuggaacuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggcuaugguacugucaauuguaucucucuuccccuuaugccuguccacgaccucccagaaaacaacauggcuuccggugcuauugggaucucuuggaugcaaaccauuaaccauguuucuuauagcagaaaacaaaaucuggggaaggaaaaguuggccccucaaugaagggaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaagcgcucaagggaaugccaauaagguaccaaacaacagcagugaagagugaacacacaggaaaagagauaguugaccucaugugucacgccacuuucaccaugcgccuccugucucccgugagaguccccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaaaaccuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggagaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaccuggucauguugcacaacuccgaacaaggaggaagagccuauagacaugcaauggaagaacugccagacaccauagaaacguugaugcuccuagcuuugauagcuguguuaacugguggagugacgcuguucuuccuaucaggaaagggccuagggaaaacaucuaucggccuacucugcgugauggcuucaagcguacugcuauggauggccaguguggagccccauuggauagcggccuccaucauacuggaguucuuccugaugguguugcuuauuccagagccagacagacaacgcacuccgcaggacaaccagcuggcauauguggugauagguuuauuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuauaccaccugagaaaugugauacccuuuugugugauauuggugaguccucuccaaacccaacuauagaggaaggaagaacgcuacgcguucuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugagggaaucuuuucacccaacgaauuagagaccccaaauuuagccgagagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccguauauccaguugggaagauguuccauaucuaggaaaaagggaagaucaaugguguggaucucugauaggcuuaacagcaagggccaccugggccaccaacauacaaguggccauaaaccaagugagaagacuaauugggaaugagaauuauucagauuacaugacaucaaugaagagauucaagaacgagagugaacccgaaggggcacucugguga

SEQ ID NO: 5565 - RNA, 9879 nt, Artificial Sequence
  derived and/or modified CDS sequence (wt) from DENV-1__FJ687430__SS-prME
ucugugaccaugcuccuuaugcugaugccuacagccuuggcguuccauuugacuacacgagggggagagccgcacaugauagucagcaagcaggaaagaggaaagucacuuuuguuuaagaccucaacaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucacaaacuggcgagcaccgacgagacaaacguuccgucgcacuggccccacacgugggacuugguuuggaaacaagaaccgaaacguggauguccucugaaggcgcuuggaaacagauacaaaaaguggagacuugggcccugagacacccaggauucacggugauagcccuuuuucuagcacaugccauaggaacauccaucacccagaaagggauuauuuucauuuuguuaaugcugguaacaccauccauggccaugcgaugcguggggauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccacugacucaagaugcccaacacaaggagaagccacacugguggaagaacaagacgcgaacuuugugugucgacgaacguuuguggacagaggcuggggcaacggcugugggcucuucggaaaaggaagccuaauaacgugugcuaaguucaagugugugacaaaacuggaaggaaagauagugcaauaugaaaauuugaaauauucaguaauagucaccguccacacuggagaccagcaccaggugggaaaugaaagcacagaacaugggacaacugcaacuauaacaccucaagcuccuacaacggaaauacagcugaccgacuacggagcucucacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccauucuagugcagauuaaauacgaaggaacagaugcaccaugcaagaucccuuuuucgacccaagaugaaaaaggaguaacccagaaugggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauugguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauacuuaggagucaugguucaggcggauucaggauguguaauuaauuggaaagguagagaacucaaauguggaagcggcauuuuugucaccaaugaaguucacacuuggacagagcaauacaaauuucaagcugacuccccaaagagacuaucagcagccauugggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuuggcucaagggaaaaagaugauuaggccacaacccauggaauacaaauacucguggaaaagcuggggaaaggcuaaaaucauaggggcagauguacagaacgccaccuucaucaucgacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggagaaguggacagcuuuucacugggacuguuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuucagacaagauggggaugggaacgacguaccuagcucugauggccacuuuuaaaaugagaccaauguuugcuguagggcuauuauuccgcagacuaacauccagagaaguucuucuucuaacaauuggacugagucuaguggcaucuguggaguuaccaaauuccuuggaggagcugggggauggacuugcaaugggcauuaugaucuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggccguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucuguuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccaggcaccuuuaagaccccugaaggugaaguuggagcuauugcccuagauuuuaaacccggcacaucuggaucucccaucgugaacagagaaggaaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauucccgagagaucauggaacucaggcuaugaguggaucacugacuucccagguaaaacaguuugguuuguuccaagcauuaaaucaggaaaugacauugccaacugcuuaagaaagaauggaaaacgggugauucaauugagcaggaaaaccuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcguguuauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugacaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacauuugacgcaaagggcccagaaugccuuggacaaccugguuauguugcacaacuccgaacaaggaggaagagccuauagacaugcacuggaagaacugccagacaccauagaaacguugaugcuccuagcuuugauagcuguguuaacugguggagugacgcuguucuuccuaucaggaaggggccuagggaaaacaucuauuggccuacucugcgugauggcuucaagcguacugcuauggauggccaguguggaaccccauuggauagcggccuccaucauauuggaguucuuccugauggugcugcucauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccucaaugcuggacguagacuuacacccagcuucagccuggacccucuaugcaguggccacaacgauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacuaacgcugacagcggcgguauugaugcuaguggcucacuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggucaaauaauguuguugauacuaugcacaucacagauccucuugaugcgaacuacaugggccuugugcgaauccaucacacuggcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaagggaggaccuggacaugaagaaccaaucccaauggcgaccuauggauggaaccuaguaaagcugcacuccgggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcagaugcaaagaaaacauggaggaaugcuagugcgaaauccacuuucaagaaauucuacucaugaaauguauuggguuucaugcggaacaggaaacauugugucagcaguaaacaugacauccagaauguuguuaaaucguuucacaauggcucacaggaaaccaacauaugaaagagacguggacuuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaacagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacgagagaggaguucacaagaaaaguuaggucaaacgcagccauuggagcaguguucguugaugaaaaucaauggaacucagcaaaagaagcaguggaagaugagcgguucugggaccuugugcacagagagagggagcuucauaaacagggaaaaugugccacguguguuuacaacaugauggggaagagagagaaaaaacuaggagaguucggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugccuuacuggcuaagucaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcucaguugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguugggaagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5566 - RNA, 9879 nt, Artificial Sequence
  derived and/or modified CDS sequence (wt) from DENV-1__FJ687432__SS-prME
ucugugaccaugcuccuuaugcugaugccuacagccuuggcguuccauuugacuacacgagggggagagccgcacaugauagucagcaagcaggaaagaggaaagucacuuuuguuuaagaccucaacaggugucaacaugugcacccuuauagcgauggauuugggagaguuaugugaggacacaaugacuuacaaaugcccucgaauuacugaggcggaaccagaugacguugauuguuggugcaaugccacagacacaugggugaccuauggaacauguucacaaacuggcgagcaccgacgagacaaacguuccgucgcacuggccccacacgugggacuugguuuggaaacaagaaccgaaacguggauguccucugaaggcgcuuggaaacagauacaaaaaguggagacuugggcccugagacacccaggauucacggugauagcccuuuuucuagcacaugccauaggaacauccaucacccagaaagggauuauuuucauuuuguuaaugcugguaacaccauccauggccaugcgaugcguggggauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccacugacucaagaugcccaacacaaggagaagccacacugguggaagaacaagacgcgaacuuugugugucgacgaacguuuguggacagaggcuggggcaacggcugugggcucuucggaaaaggaagccuaauaacgugugcuaaguucaagugugugacaaaacuggaaggaaagauagugcaauaugaaaauuugaaauauucaguaauagucaccguccacacuggagaccagcaccaggugggaaaugaaagcacagaacaugggacaacugcaacuauaacaccucaagcuccuacaacggaaauacagcugaccgacuacggagcucucacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccauucuagugcagauuaaauacgaaggaacagaugcaccaugcaagaucccuuuuucgacccaagaugaaaaaggaguaacccagaaugggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauugguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauacuuaggagucaugguucaggcggauucaggauguguaauuaauuggaaagguagagaacucaaauguggaagcggcauuuuugucaccaaugaaguucacacuuggacagagcaauacaaauuucaagcugacuccccaaagagacuaucagcagccauugggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuuggcucaagggaaaaagaugauuaggccacaacccauggaauacaaauacucguggaaaagcuggggaaaggcuaaaaucauaggggcagauguacagaacgccaccuucaucaucgacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggagaaguggacagcuuuucacugggacuguuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuucagacaggauggggaugggaacgacguaccuagcucugauggccacuuuuaaaaugagaccaauguuugcuguagggcuauuauuccgcagacuaacauccagagaaguucuucuucuaacaauuggacugagucuaguggcaucuguggaguuaccaaauuccuuggaggagcugggggauggacuugcaaugggcauuaugaucuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggccguuggaauagucagcauccuauuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucuguuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccaggcaccuuuaagaccccugaaggugaaguuggagcuauugcccuagauuuuaaacccggcacaucuggaucucccaucgugaacagagaaggaaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauucccgagagaucauggaacucaggcuaugaguggaucacugacuucccagguaaaacaguuugguuuguuccaagcauuaaaucaggaaaugacauugccaacugcuuaagaaagaauggaaaacgggugauucaauugagcaggaaaaccuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcguguuauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugacaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacauuugacgcaaagggcccagaaugccuuggacaaccugguuauguugcacaacuccgaacaaggaggaagagccuauagacaugcacuggaagaacugccagacaccauagaaacguugaugcuccuagcuuugauagcuguguuaacugguggagugacgcuguucuuccuaucaggaaggggccuagggaaaacaucuauuggccuacucugcgugauggcuucaagcguacugcuauggauggccaguguggaaccccauuggauagcggccuccaucauauuggaguucuuccugauggugcugcucauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccucaaugcuggacguagacuuacacccagcuucagccuggacccucuaugcaguggccacaacgauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacuaacgcugacagcggcgguauugaugcuaguggcucacuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggucaaauaauguuguugauacuaugcacaucacagauccucuugaugcgaacuacaugggccuugugcgaauccaucacacuggcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaagggaggaccuggacaugaagaaccaaucccaauggcgaccuauggauggaaccuaguaaagcugcacuccgggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguuguuaaaucguuucacaauggcucacaggaaaccaacauaugaaagagacguggacuuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaacagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacgagagaggaguucacaagaaaaguuaggucaaacgcagccauuggagcaguguucguugaugaaaaucaauggaacucagcaaaagaagcaguggaagaugagcgguucugggaccuugugcacagagagagggagcuucauaaacagggaaaaugugccacguguguuuacaacaugauggggaagagagagaaaaaacuaggagaguucggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugccuuacuggcuaagucaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcucaguugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguugggaagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5567 - RNA, 9879 nt, Artificial Sequence
  derived and/or modified CDS sequence (wt) from DENV-1__JQ922547__SS-prME
uccgugaccaugcuccuuaugcugcugcccacagcccuggcguuccaucugacgacacgagggggagagccgcauaugauaguuagcaagcaggaaagaggaaagucacuuuuguucaagaccucugcaggugucaacaugugcacccuuauugcgauggauuugggagaguugugugaggacacaaugaccuacaaaugcccccggaucacugaggcggaaccagaugacguugacuguuggugcaaugccacggacacaugggugaccuauggaacguguucucaaacuggcgaacaccgacgagacaaacguuccgucgcauuggccccacacguggggcuuggccuagaaacaagagccgaaacguggauguccucugaaggcgcuuggaaacagauacaaaaaguagagacuugggcucugagacacccaggauucacagugauagcccuuuuucuagcacaugccauaggaacauccaucacccagaaagggaucauuuucauuuuacugaugcugguaacaccaucuauggccaugcgaugugugggaauaggcaacagagacuucguggaaggacugucaggagcaccuuggguggaugugguacuggaacauggaaguugcgucaccaccauggcaaaaaauaaaccaacacuggacauugaacucuugaagacggaggucacaaacccugcaguucugcguaaacuguguauugaagcuaaaauaucaaacaccaccaccgauucgagauguccaacacaaggagaagccacacugguggaagaacaagacgcgaacugugugugccgacgaacguucguggacagaggcuggggcaauggcugugggcuauucggaaaagguagucuaauaacgugugccaaguuuaagugugugacaaaacuagaaggaaagauaguucaauaugaaaacuuaaaauauucagugauagucaccguccacacuggagaucagcaccaggugggaaaugagaccacaacccauggaacaacugcaaccauaacaccucaagcucccacgucggaaauacagcugaccgacuacggagcccuuacacuagauuguucaccuagaacagggcuagauuuuaacgagaugguguugcugacaaugaaagaaaaaucauggcuuguccacaaacaaugguuucuagacuuaccacugccuuggaccucuggggcuucaacaucccaagagacuuggaacagacaagauuuacuggucacauuuaagacagcucaugcaaagaagcaggaaguggucguacuaggaucacaagaaggagcaaugcacacugcgcugacuggagcgacagaaauccaaacgucaggaacgacaacaauuuucgcaggacaccuaaaaugcagacuaaaaauggacaaacuaacuuuaaaagggaugucauaugugaugugcacaggcucauucaaguuagagaaagaaguggcugagacccagcauggaacuguucuggugcagguuaaauaugaaggaacagacgcaccaugcaagauccccuuuucaacccaagaugagaaaggagcaacccagaaugggagauuaauaacagccaaccccauagucacugacaaagaaaaaccagucaauauugaggcagaaccacccuuuggugagagcuacaucgugguaggagcaggugaaaaagcuuugaaacuaagcugguucaagaaaggaagcagcauagggaaaaugcuugaagcaacugcccgaggagcacgaaggauggccauccugggagacaccgcaugggacuucgguucuauaggaggaguguucacgucuaugggaaaacugguacaccagguuuuuggaacugcauauggaguuuuguuuagcgguguuucuuggaccaugaaaauaggaauagggauucugcugacauggcuaggauuaaauucaaggaacacgucccuuucgaugaugugcaucgcaguuggcauggucacacuguaccuaggagucaugguucaggcagauucgggauguguaaucaauuggaagggcagagaacuuuuauguggaacuggcauuuuugucacuaaugagguccacacuuggacagauccauacaaauuccaggcugaccccuccaauagacuaucacccaucauugggaaggcguguguaauccguguguguggaauacgaucagccacucgucucgagaauaucauguggaaacaaauaucaaaugaauugaaccacauccuacucgaaaaugacaugaaauuuacaguggucgugggagauguuaguggaaucuuggcccaaggggaaaaaaugauuaggccacaacccauggaacacaaauacucguggaaaagcuggggaaaagcuaaaaucauaggagcggauguacagaacaccaccuucaucaucgacggcccaaacaccccagaaugcccugauaaucaaagagcauggaauaucugggaaguagaggauuauggauuugggauuuucacgacaaacauaugguugaaauugcgugacuccuacacccaaguaugugaccaccggcuaaugucagcugccaucaaggacagcaaggcaguccaugcugacaugggguacuggauagaaagugaaaagaacgagaccuggaaguuggcgagagccuccuuuauagaaguuaagacaugcaccuggccaaaaucccacacucuauggagcaauggaguucuggaaagugaaaugauaaucccaaagauauauggaggaccaauaucucagcacaacuacagaccaggauauuucacacaaacagcagggccguggcaccuaggcaaguuggaacuagauuucgauuuuugugaagguaccacaguuguuguggaugaacauuguggaaaucgaggaccaucucuuagaaccacaacagucacaggaaaaauaauucaugaauggugcuguagaucuuguacgcuaccucccuuacguuucaaaggggaagacggguguugguacggcauggaaaucagaccagugaaggacaaggaagagaaccuggucaaaucaauggucucugcagggucaggagaaguggacagcuuuucacuaggacugcuaugcauaucaauaaugauugaagaggugaugagauccagauggagcaaaaaaaugcugaugguuggaacacuggcuguguuccuccuucuuauaaugggacaauugacauggagugaucugaucagguuauguauuaugguuggagccaaugcuucagacaggauggggaugggaacaacguaccuagcuuugauggccacuuucaaaaugagaccaauguucgcugucgggcuauuauuucccaaacuaacaucuagagaaguucuucuucuuacaauuggcuugagccugguggcauccguggagcuacccaguucccuagaggagcugggggauggacuugcaaaaggcaucaugauguuaaaauuauugacggauuuucagucacaccagcuaugggcuacucugcuauccuugacauuuaucaaaacaacuuuuucauugcacuaugcauggaagacaauggcuaugguacugucaauuguaucucucuucccuuuaugucuguccacgaccucucaaaaaacaacauggcuuccggugcuguugggaucucuuggaugcaaaccacuacccauguuucuuauaacagaaaacaaaaucuggggaaggaaaaguuggccccucaaugaaggaauuauggcugucggaauaguuaguauucuacuaaguucacuucuaaaaaaugaugugccgcuagccggcccacuaauagcuggaggcaugcuaguagcauguuaugucauauccggaagcucagcugauuuaucacuggagaaagcggcugaggucuccugggaggaagaagcagaacacucaggugccucacacaacauacuaguagagguucaagaugauggaaccaggaagauaaaagaugaagagagagaugacacgcucaccauucuccuuaaagcaacucugcuggcaguuucagggguguacccaaugucaauaccagcaacccuuuuugugugguauuuuuggcagaaaaagaaucagagaucaggaguuggacucaucacacccagccccccagaaguggaaagagcaguucucgaugauggcaucuauagaauuuugcaaagaggacuguugggcaggucccaaguaggaguaggaguuuuccaagaaggcguguuccacacaauguggcacgucacuaggggagcuguccucauguaucaagggaaaaggcuggaaccaagcugggccagugucaaaaaagacuugaucucauauggaggagguuggagguuucaaggauccuggaacacgggagaagaaguacaggugauugcuguugaaccgggaagaaaccccaaaaauguacaaacagccccggguaccuucaagaccccugaaggcgaaguuggagccauacccuuagauuuuaaacccggcacaucuggaucucccaucguaaacagagagggaaaaauaguaggucuuuauggaaauggaguggugacaacaagcggaacuuacguuagugccauagcucgagcuaaggcaucacaagaagggccucuaccagagauugaggacgagguguuuaggaaaagaaacuuaacaauaauggaccuacauccaggaucgggaaaaacaagaagauaccuuccagccauaguccgugaggccauaaaaaggaagcugcgcacgcuaauccuagcucccacaagaguugucgcuucugaaauggcagaggcgcucaagggagugccaauaagguaucagacaacagcagugaagagugaacacacaggaaaggagauaguugaccuuaugugccaugccacuuucaccaugcgccuccugucucccgugagaguucccaauuauaacaugauuaucauggaugaagcacauuuuaccgauccagccagcauagcagccagaggguacaucucaacccgaguggguaugggugaagcagcugcgaucuuuaugacagccacucccacaggaucgguggaggccuuuccacagagcaaugcaauuauccaagaugaggaaagagacauuccugagaggucauggaacucaggcuaugacuggaucacugauuuuccagguaaaacagucugguuuguuccaagcaucaaaucaggaaaugacauugccaacuguuuaaaaaaaaacgggaaacgggugauccaauugagcagaaaaaccuuugacacugaguaccagaaaacaaaaaacaacgacugggacuaugucgucacaacagacauuuccgaaaugggagcaaacuuccgggccgauaggguaauagacccaaggcggugucugaaaccgguaauacuaaaagaugguccagagcgcgucauucuagccggaccgaugccagugacuguggccagugccgcccagaggagaggaagaauuggaaggaaccaaaacaaggaaggugaucaauauauuuacaugggacagccuucaaacaaugaugaggaccacgcucauuggacagaagcaaagaugcuccuugacaauauaaacacaccagaagggauuaucccagcccucuuugagccggagagagaaaagagugcagcaauagacggggaauacagacugcggggugaagcaaggaaaacguucguggagcucaugagaagaggagaucuaccugucuggcuauccuacaaaguugccucagaaggcuuccaguacuccgacagaagguggugcuucgauggggaaaggaacaaccagguguuggaggagaacaaggacguggagaucuggacaaaagaaggagaaagaaagaaacuacgaaccugcugguuggacgccagaacauacucugacccacuggcucugcgcgaguuuaaagaguuugcagcaggaagaagaagcgucucaggugaccuaauauuagaaauagggaaacuuccacaacauuugacgcaaaaggcccagaaagcuuuggacaacuuggucauguugcacaauuccgaacaaggaggaaaagccuauagacaugcuauggaagaacugccagacacaauagaaacguugaugcuccuagccuugauagcuguguugacugguggagugacgcuguucuuccuaucaggaagaggucuaggaaaaacauccaucggccuacucugcgugauggccucaagcguacuguuauggauggccaguguggagccccauuggauagcagccuccaucauacuggaguucuuucugauggugcugcuuauuccagagccagacagacagcguacuccacaggacaaccagcuagcauauguggugauaggucugcuauucaugauauugacaguggcagccaaugagaugggauuacuggaaaccacaaagaaagaccuggggauuggccauguagcugcugaaaaccaccaccaugcuacaaugcuggacguagaccuacguccagcuucagccuggacccucuaugcaguggccacaacaaucaucacuccuaugaugagacacacaauugaaaacacaacggcaaauauuucccugacagccaucgcaaaccaagcagcuauauugaugggacuugacaagggauggccaauaucgaagauggacauaggaguuccacuucucgccuuggggugcuauucccaggugaacccgcugacgcugacagcggcaguauugaugcuaguggcucauuacgccauaauuggaccuggacugcaagcaaaagcuacuagagaagcucaaaaaagaacagcggcuggaauaaugaaaaauccaacugucgacgggauuguugcaauagacuuggaucccgugguuuacgaugcaaaauuugaaaaacagcuaggccaaauaauguuguugauacuuugcacaucacagauucucuugaugcggacuacaugggccuugugugaauccaucacauuggcuacuggaccucugaccacucuuugggagggaucuccaggaagauucuggaacaccacaauagcgguauccauggcaaacauuuucagggggaguuaucuagcaggagcaggucuggccuucucauuaaugaaaucucuaggaggagguaggagaggcacgggagcccaaggggaaacacugggagaaaaauggaaaagacagcuaaaccaacugagcaagucagaauucaauacuuacaaaaggagugggauuauggagguggauagauccgaagccaaagagggacugaaaagaggagaaacaaccaaacacgcaguaucgagaggaacggccaaacugaggugguucguggagaggaaccuugugaaaccagaagggaaagucauagaccucgguuguggaagagguggcuggucauauuauugcgcugggcugaagaaagucacagaagugaaaggauacacaaaaggaggaccgggacaugaggaaccaaucccaauggcgaccuauggauggaaccuaguaaagcuacacuccggaaaagauguauuuuuuauaccaccugagaaaugugacacccuuuugugugauauuggugaguccucuccgaacccaacuauagaagaaggaagaacguuacguguucugaaaaugguggaaccauggcucagaggaaaccaauuuugcauaaaaauuuuaaaucccuauaugccgagugugguagaaacucuggaacaaaugcaaagaaaacauggaggaaugcuagugcgaaacccacucucaagaaauuccacccaugaaauguacuggguuucauguggaacaggaaacauugugucagcaguaaacaugacaucuaggauguugcuaaaucgguucacaauggcucacaggaagccaacauaugaaagagacguggacuuaggcgcuggaacgagacauguggcaguagaaccagagguagccaaccuagacaucauuggccagaggauagagaauauaaaaaaugaacauaagucaacauggcauuaugaugaggacaauccauacaaaacaugggccuaucauggaucauaugagguuaagccaucaggaucggccucauccauggucaauggcguggugagauugcucaccaaaccaugggauguuauccccauggucacacaaauagcuaugacugacaccacacccuuuggacaacagaggguguuuaaagagaaaguugacacgcgcacaccaaaagcaaaacguggcacagcacaaauuauggaagugacagccaggugguuaugggguuuccuuucuagaaacaaaaaacccagaauuugcacaagagaggaguuuacaagaaaaguuaggucaaacgcagcuauuggagcaguguucguugaugaaaaucaauggaacucagcaaaagaagcaguggaagacgaacgguucugggaccuugugcacagagagagggagcuucauaaacaggggaaaugugccacgugugucuacaauaagauggggaagagagagaaaaaauuaggagaguucggaaaggcaaaaggaagucgugcaauaugguacaugugguugggagcacgcuuccuagaguucgaagcccuugguuucaugaaugaagaucacugguucaguagagagaauucacucaguggaguggaaggagaaggacuccacaaacuuggauacauacucagagacauaucaaggauuccagggggaaacauguaugcagaugacacagccggaugggacacaagaauaacagaggaugaucuccagaaugaggcuaaaaucacugacaucauggagcccgagcaugcccuguuggccacgucaaucuuuaagcugaccuaccaaaauaaggugguaagggugcagagaccagcaaaaaauggaaccgugauggaugcuauauccagacgugaccagagaggaaguggacagguuggaacuuauggcuuaaacacuuuccuucacaaggaggcccaacugauaagacaaauggaguuugagggaaucuuuuuacccagcgaauuggaaaccccaaaucuagccggaagaguucucgacugguuggaacaauauggugucgaaaggcugaaaagaauggcaaucagcggagaugacuguguggugaaaccaauugaugacagguucgcaacagccuuaacagcuuugaaugacaugggaaaaguaagaaaagacauaccacaaugggaaccuucaaaaggauggggugauuggcaacaagugccuuucuguucacaccacuuccaccagcuaauuaugaaggaugugagggagauaguggugccaugccgcaaccaagaugaacuuguggggagggccagaguaucacaaggcgccggauggagccugagagaaaccgcaugccuaggcaagucauaugcacaaauguggcagcugauguauuuccacaggagagacuugagacuggcggcuaacgccaucuguucagccguuccaguugauugggucccaaccagccgcaccaccuggucgauccaugcccaucaccaauggaugacaacagaagacauguuaucaguauggaauagggucuggauagaggaaaacccauggauggaggauaagacucauguguccaguugggaagauguuccauaccuagggaaaagggaagaucagugguguggauccuugauaggcuuaacagcaagggccaccugggccacuaauauacaaguggccauaaaccaagugagaaggcucauugggaaugagaauuaucuagauuacaugacaucaaugaagagauucaagaaugagagugaucccgaaggggcacucugguaa

SEQ ID NO: 5568 - RNA, 9879 nt, Artificial Sequence
  derived and/or modified CDS sequence (wt) from DENV-1__EU482567__SS-prME
ucugugaccaugcuucucaugcugcugcccacagcccuggcguuccauuugacuacacgagggggagagccacacaugauagucaguaagcaggaaagaggaaagucacuguuguucaagaccucugcaggcaucaacaugugcacucucauugcgauggauuugggagaguuaugcgaggacacaaugaccuacaaaugcccccggaucacugaggcggaaccagaugacguugacugcuggugcaaugccacagacacaugggugaccuacgggacguguucucaaaccggcgaacaccgacgagacaaacguuccguggcacuggccccacacgugggacuuggucuagagacaagaaccgaaacauggauguccucugaaggugccuggaaacaaauacaaaaaguggagacuugggcuuugagacacccaggauucacggugacagcccuuuuuuuagcacaugccauaggaacauccauuacucagaaagggaucauuuucauuuugcugauacuaguaacaccaucaauggccaugcgaugugugggaauaggcaacagagacuucguugaaggacugucaggagcaacguggguggacgugguauuggagcauggaagcugcgucaccaccauggcaaaagauaaaccaacauuggacauugaacucuugaagacggaggucacaaacccugccgucuugcgcaaacugugcauugaagcuaaaauaucaaacaccaccaccgauucaagguguccaacacaaggagaggccacacugguggaagaacaagacucgaacuuugugugucgacgaacguuuguggacagaggcugggguaauggcugcggacuauuuggaaaaggaagccuacugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccccaagcuccaacgucggaaauacagcugacugacuacggagcccucacauuggacugcucgccuagaacagggcuggacuuuaaugagauggugcuauugacaaugaaagaaaaaucauggcuuguccacaaacaaugguuucuagacuuaccacugccuuggacuucaggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaaagggaugucauauguaaugugcacaggcucauuuaagcuagagaaggaaguggcugagacccagcauggaacuguucuagugcagguuaaauacgaaggaacagaugcgccaugcaagaucccuuuuucggcccaagaugagaaaggagugacccagaaugggagauugauaacagccaaccccauagucacugacaaagaaaaaccagucaacauugagacagaaccaccuuuuggugagagcuacaucgugguaggggcaggugaaaaagcuuugaaacugagcugguucaagaaagggagcagcauagggaaaauguucgaagcaacugcccgaggagcacgaaggauggcuauccugggagacaccgcaugggacuuuggcucuauaggaggaguguucacaucagcgggaaaauugguacaccagguuuuuggagccgcauaugggguucuauucagcggaguuucuuggaccaugaaaauaggaauagggauucugcugacaugguugggauuaaauucaaggagcacgucacuuucgaugacgugcauugcgguuggcauggucacacuguaccuaggagucgugguucaagcggacucgggauguguaaucaacuggaagggcagagaacucaaauguggaagugguauuuuugucacuaaugaaguccacacuuggacagagcaauacaaauuccaggcugacuccccaaaaagacugucagcagccauugggaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuagcccaagggaaaaaaaugauuaggccacaacccauggaacauagauacucauggaaaagcuggggaaaagccaaaaucauaggagcagacauacagaaugccaccuucaucaucgacggcccagauacuccagaaugccccgaugaccaaagagcguggaacauuugggaaguugaagacuaugguuuuggaauuuucacgacaaacauauggcugaaauugcgcgacuccuacacccaaaugugugaccaccggcuaaugucagcugccaucaaagacagcaaggcaguccaugcugacaugggguacuggauagaaagcgaaaagaacgagaccuggaagcuagcgagagccuccuucauagaagucaagacauguaucuggccgaaaucccacacucuauggaguaauggaguuuuggaaagugaaaugauaaucccaaagauauauggaggaccaauaucucagcacaacuacagaccaggguauuucacacaaacagcagggccguggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacgcuucagaggagaagacggauguugguauggcauggaaaucagaccaguuaaggagaaggaggaaaaccuaguuaggucaauggucucugcagggucaggagaaguggacaguuuuucacuagggauacuaugcguaucaauaaugauugaagaagugaugagauccagauggaguagaaagaugcugaugacuggaacacuggcuguuuuucuccuucuuauaaugggacaacugacauggaaagaucugauuagguuaugcaucaugguuggagcuaaugcuucagacaggauggggaugggaacaacguaccuggccuugauggccacuuucaaaaugcgaccaauguucgcuguugggcuauuauuucgcagacuaacauccagagaaguucuucuucucacgauuggauuaagccugguggcauccguggaguuaccaaauucuuuggaggagcuaggggauggacuugcaauggguaucaugauguuaaaauuauugacugaauuucagccacaccaguuauggaccaccuuacugucuuugacauucaucaacacaacucuuucauuggauuaugcauggaggacaauggcuauggugcuaucaaucauaucucucuuuccuuuaugucugucuacgaccucccaaaaaacaacauggcuuccggugcuguuaggaucuuuuggaugcaaaccauuaaccauguuucuuauaacagaaaacaaaauuuggggaaggaaaagcuggccccucaaugaaggaauuauggcuauuggaauagucagcauucuacuaaguucacuccuuaaaaaugaugugccguuagccggcccacuaauagcuggaggcaugcuaauagcauguuaugucauauccggaaguucagccgauuuaucauuggagaaagcagcugagguauccugggaagaagaagcagaacacucugguaccucacacaacauauuaguagagguccaagaugauggaaccaugaaaauaaaagaugaagagagggaugacacacucaccauacuccucaaagcaacucugcuggcagucucaggaguguacccaaugucaauaccagcaacucuuuucgugugguauuuuuggcagaaaaagaaacaaagaucaggaguguuaugggacacacccagcccuccggaaguggaaagagcaguucuugaugauggcaucuauagaauccugcaaagaggacuguugggcaggucccaaguaggagugggaguuuuccaagacggcgucuuccacacaauguggcacgucaccaggggagcuguccuuauguaccaagggaagagguuggaaccaagcugggccagugucaaaaaggacuugaucucauauggaggagguuggagauuucaaggaucauggaacacgggagaagaggugcaggugauagcuguugaaccaggaaaaaaucccaaaaauguacagacaacgccggguaccuucaagacucccgaaggcgaaguuggagccauagcucuagacuuuaaacccggcacaucuggaucucccaucgugaacagagagggaaaaauaguaggucuuuauggaaauggaguggugacaacaaguggaaccuacgucagugccauugcccaagcuaaaacaucacaagaagggccucuaccagagauugaggacgagguguuuaagaaaaggaacuuaacaauaauggaccugcauccaggaucgggaaagacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugaucaucauggaugaagcacacuuuaccgauccagccagcauagcggccagaggguacaucucaacucgaguggguaugggugaagcagcugcgaucuuuaugacagccacucccccaggaucgguggaggccuuuccacaaagcaaugcaguuauccaagaugaggaaagagacauuccagagagaucauggaacucaggcuacgacuggaucacugauuuuccagguaaaacagucugguuuguuccaagcauuaagucaggaaaugacauugcuaacuguuuaagaaagaacggaaaacgggugauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccagugauacuaaaagaugguccagagcgugucauucuagccggaccgaugccagugacuguggccagugcugcccagagaagaggaagaauuggaaggaaccaaaacaaggaaggugaucaguacguuuauaugggacagccuuuaaauaaugaugaggaccacgcucauuggacagaagcaaaaaugcuccuugacaauauaaacacaccagaagggaucauuccagcccucuuugagccagagagagaaaagagugcagcaauagauggggaguacagacugcggggagaagcaaggaaaacauucguggagcucaugagaagaggagaucuaccaguuuggcuauccuacaaaguugccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccuucgugaguucaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuucuaucaggaaaaggucuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggacaaccagcuagcauacguggugauagguuuguuauucaugauacugacaguggcagccaaugagaugggacuauuggaaaccacaaagaaagaccuggggauuggccauguugccgccgaaaaccaccaccaugccacgaugcuggacguagaccuacgcccagcuucagccuggacccucuaugcaguagccacaacaguuaucacucccaugaugagacacacaauugaaaacacaacggcaaacauuucccugacggccauugcaaaccaggcagcuauauugaugggacuugauaagggauggccaauaucgaagauggacauaggaguuccacuucucgccuuagggugcuauucccaggugaacccauugacacugacagcagcgguguugauguuaguggcucauuaugccauaauuggaccaggacuccaagcaaaggccacuagagaagcucaaaaaaggacagcggccggaauaaugaaaaauccaaccguagacgggauugucgcaauagacuuggauccugugguuuaugaugcaaaauuugaaaaacaguuaggccaaauaauguuacugauacuuugcacaucacagauucucuugaugcggaccacaugggccuugugugaauccaucacacuggcuacuggacccuugaccacucucugggagggaucuccaggaaaauucuggaauaccacgauagcaguguccauggcaaacaucuucaggggaaguuaucuagcaggagcaggucuggccuucucguuaaugaaaucuuugggaggaggcaggagagguacgggggcucaaggagaaacacugggagagaaauggaaaagacaguuaaaccaacugagcaagucagaauucaacaccuacaaaaggagugggauuauggagguggacagauccgaagccagagagggauuaaaaagaggagaaacaaccaaacaugcagugucgagaggaacagccaaacugaggugguuuguggagagaaaccucgugaaaccagaagggaaagucauagaccucgguuguggaagagguggcuggucauauuauugugcugggcugaagaaagucacugaagucaaggguuacacaaaaggaggaccuggacaugaggaaccuaucccaauggcgaccuauggauggaaccuaguaaagcuauacucuggaaaagauguguuuuuuauaccaccugagaaaugugauacccuucugugugauauaggagaguccucuccgaauccaacuauagaagaaggaagaacguuacguguucuaaagaugguagaaccauggcucagaggaaaccaauucuguauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucaucggccagaggauagagaauauaaaaaaugaacacaagucaacauggcauuaugaugaagacaauccauacaaaacaugggccuaucauggaucauaugaggucaaaccaucaggaucagccucaucuauggugaauggcgugguaagauugcucacaaaaccaugggaugucauccccauggucacacaaauagccaugaccgauaccacacccuucggacaacagagaguguuuaaagagaaaguagacacgcgcacaccaagagcaaaacgaggcacagcacaaauuauggaggugacagccaagugguuaugggguuuccuuuccagaaacaaaaaacccagaaucuguacaagagaggaguucacaagaaagguuaggucaaacgcagcaauaggagcaguguucguugaugaaaaccaauggaacucagcaaaagaagcaguggaagacgaaagguuuuggaaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuagaguucgaagcccuugguuucaugaaugaagaucacugguucaguagagagaauucauuuaguggaguggaaggagaaggacugcacaaacuuggauacauacucagagacauaucaaagaucccggggggaaauauguaugcagaugacacagccggaugggacacaagaauaacagaggaugaucuucaaaaugaggcuaaaaucacugacaucauggagccugaacacgcucuauuggcuacgucaauuuuuaagcugaccuaccaaaacaaggugguaagagugcaaagaccagcaaaaaauggaaccgugauggauguuauauccagacgagaccagagaggaagugggcaagucggaaccuauggcuuaaauacuuucaccaauauggagguccaacuaauaagacaaauggagucugaaggaaucuuuuuacccagcgaauuggaaacccccaaucuagcugagagaguucuugacugguuggaaaaacauggcaccgaaaggcugaaaagaauggcaauuagcggagaugauuguguggugaaaccaguugacgagagguuugcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccuaagacuagcggcuaaugcuaucuguucagcugucccaguugacugggucccaaccagccgcacaaccuggucaauccaugcucaccaucaauggaugacaacagaagacauguuaucaguguggaauaggguuuggauagaggaaaacccauggauggaggacaaaacucauguauccagcugggaagaagucccauacuuagggaaaagggaagaucaaugguguggaucccugauaggcuugacagcuagggccacuugggccacuaacauacaaguagccauaaaccaagugagaaggcucaucgggaaugagaauuaucuagauuacaugacaucaaugaagagauucaagaaugagagugaucccgaaggggcacucugguaa

SEQ ID NO: 5569 - RNA, 9879 nt, Artificial Sequence
  derived and/or modified CDS sequence (wt) from DENV-1__FJ390378__SS-prME
ucugugaccaugcuccucaugcugcugcccacagcccuggcguuccauuugacuacacgagggggagagccacacaugauaguuaguaagcaggaaagaggaaagucacuguuguuuaagaccucugcaggcaucaauaugugcacucucauugcgauggaucugggagaguuaugcgaggacacaaugaccuacaaaugcccccggaucacugaggcggaaccagaugacguugacugcuggugcaaugccacagacacaugggugaccuaugggacauguucucaaaccggcgaacaccgacgagacaaacguuccguggcacuggccccacacgugggacuuggucuagaaacaagaaccgaaacauggauguccucugaaggugccuggaaacaaauacaaaaaguggagacuugggcuuugagacacccaggauucacggugacagcccuuuuuuuagcacaugccauaggaacauccauuacucagaaagggaucauuuucauuuugcugaugcuaguaacaccaucaauggccaugcgaugugugggaauaggcaacagggacuucguugaaggacugucaggagcaacguggguggacgugguauuggagcauggaagcugcgucaccaccauggcaaaagauaaaccaacauuggacauugaacucuugaagacggaggucacaaacccugccgucuugcgcaaacugugcauugaagcuaaaauaucaaacaccaccaccgauucaagguguccaacacaaggagaggccacacugguggaagaacaagacucgaacuuugugugucgacgaacguuuguggacagaggcugggguaauggcugcggacuauuuggaaaaggaagccuacugacgugugcuaaguucaagugugugacaaaacuagaagggaagauaguucaauaugaaaacuuaaaauauucagugauagucacuguccacacuggggaccagcaccaggugggaaacgagacuacagaacauggaacaauugcaacuauaacaccucaagcuccuacgucggaaauacagcugacugacuacggagcccucacauuggacugcucaccuagaacagggcuggacuuuaaugagaugguucuauugacaaugaaagaaaaaucauggcuuguccacaaacaaugguuucuagacuuaccacugccuuggacuucaggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacgaucuuugcaggacaccugaaaugcagacuaaaaauggauaaacugacuuuaaaaggaaugucauauguaaugugcacaggcucauuuaagcuagagaaggaaguggcugagacccagcauggaacuguucuagugcagguuaaauacgaaggaacagaugcgccaugcaagaucccuuuuucggcccaagaugagaaaggagugacccagaaugggagauugauaacagccaaccccauagucacugacaaagaaaaaccagucaacauugagacagaaccaccuuuuggugagagcuacaucgugguaggggcaggugaaaaagcuuugaaacugagcugguucaagaaagggagcagcauagggaaaauguucgaagcaacugcccgaggagcacgaaggauggcuauccugggagacaccgcaugggacuuuggcucuauaggaggaguguucacaucagugggaaaauugguacaccagguuuuuggagccgcauaugggguucuguucagcgguguuucuuggaccaugaaaauaggaauagggauucugcugacaugguugggauuaaauucaaggagcacgucacuuucgaugacgugcauugcgguuggcauggucacacuguaccuaggagucaugguucaagcggacucgggauguguaaucaacuggaagggcagagaacucaaauguggaagugguauuuuugucacuaaugaaguccacacuuggacagagcaauacaaauuccaggcugacuccccaaaaagacugucagcagccauugggaaggcaugggaagagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacauagauacucauggaaaagcuggggaaaagccaaaaucauaggagcagacauacagaauagcaccuucaucaucgacggcccagauacuccagaaugccccgaugaccaaagagcguggaacauuugggaaguugaagacuauggguuuggaauuuucacgacaaacauauggcugaaauugcgcgacuccuacacccaaaugugugaccaccggcuaauguccgcugccaucaaagacagcaaagcaguccaugcugacaugggguacuggauagaaagugaaaagaacgagaccuggaagcuagcgagagccuccuucauagaagucaagacauguaucuggccgaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuucgacuugugugaagguaccacaguuguuguggaugaacauuguggaaaucgaggcccaucucucagaaccacaacagucacaggaaagauaauccaugaaugguguugcagauccugcacguuaccccccuuacgcuucagaggagaagacggauguugguauggcauggaaaucagaccaguuaaggagaaggaggaaaaccuaguuaggucaauggucucugcagggucaggagaaguggacaguuuuucacuagggauacuaugcguaucaauaaugauugaagaagugaugagauccagauggaguagaaagaugcugaugacuggaacauuggcuguuuuccuccuucuuauaaugggacaacugacauggaaugaccugauuagguuaugcaucaugguuggagcuaaugcuucagacaggauggggaugggaacaacguaccuggccuugauggcuacuuucaaaaugagaccaauguucgcuguugggcuacuauuucgcagacuaacauccagagaaguucuucuucucacgauuggauuaagccugguagcauccguggaguuaccaaauucuuuggaggagcuaggggauggacuugcaauggguaucaugauguuaaaauuauugacugaauuucagccacaccaguuauggaccaccuuacugucuuugacauuuaucaaaacaacucuuucauuggauuaugcauggaggacaauggcuauggugcugucaaucguaucucucuuuccuuuaugucugucuacgaccucccaaaaaacaacauggcuuccggugcuguuaggaucuuuuggaugcaaaccauuaaccauguuucuuauaacagaaaacaaaauuuggggaaggaaaaguuggccccucaaugaaggaauuauggcuauuggaauagucagcauucuacuaaguucacuccuuaaaaaugaugugccguuggccggcccacuaauagcuggaggcaugcuaauagcauguuaugucauauccggaagcucagccgauuuaucauuggagaaagcggcugagguauccugggaagaagaagcagaacacucugguaccucacacaacauauuaguagagguccaagaugauggaacuaugaaaauaaaagaugaagagagggaugacacacucaccauacuccucaaagcaacucugcuggcagucucaggaguguacccaaugucaauaccagcaacucuuuucgugugguauuuuuggcagaaaaagaaacagagaucaggaguguuaugggacacacccagcccuccggaaguggaaagagcaguucuugaugauggcaucuauagaauccugcaaagaggacuguugggcaggucccaagugggagugggaguuuuccaggacggcguguuccacacaauguggcacgucaccaggggagcuguccuuauguaccaagggaagagguuggaaccaagcugggccagugucaaaaaggacuugaucucauauggaggagguuggagauuucaaggaucauggaacacgggagaagaggugcaggugauagccguugaaccaggaaaaaauccuaaaaauguacagacaacgccggguaccuucaagacucccgaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaaacaucacaagaagggccucuaccagagauugaggaggagguguuuaagaaaaggaacuuaacaauaauggaccugcauccaggaucgggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacucgaguggguaugggugaagcagcugcgaucuuuaugacagccacucccccaggaucgguggaggccuuuccacaaaguaaugcaguuauccaagaugaggaaagagacauuccugagagaucauggaacucaggcuacgacuggaucacugauuuuccagguaaaacagucugguuuguuccaagcauuaagucaggaaaugacauugcuaacuguuuaagaaagaacggaaaacgggugauccaauugagcagaaaaaccuuugacacugaguaccagaaaacaagaaacaaugacugggacuauguugucacaacagacauuuccgaaaugggggcaaauuuccgggccgacaggguaauagacccaaggcggugcuugaaaccagugauacuaaaagaugguccagagcgugucauucuagccggaccgaugccagugacuguggccagugcugcccagagaagaggaagaauuggaaggaaccaaaacaaggaaggugaucaguacguuuauaugggacagccuuuaaauaaugaugaggaucacgcucauuggacagaagcaaaaaugcuccuugacaauauaaacacuccagaagggaucauuccagcccucuuugagccagagagagaaaagagugcagcaauagauggagaguacagacugcggggagaagcaaggaaaacauucguggagcucaugagaagaggagaucuaccaguuuggcuauccuacaaaguugccucagaagguuuccaguacuccgacagaagguggugcuuugacggggaaaggaacaaccagguguuggaggagaacauggacguggagaucuggacaaaggaaggagaaaggaagaaauugcgaccccgcugguuggaugccagaacauacucugauccacuggcccuucgugaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggacaaccagcuagcauacguggugauagguuuguuauucaugauacugacaguggcagccaaugagaugggauuauuggaaaccacaaagaaagaccuggggauuggcuauguagccgccgaaaaccaacaccaugccacgaugcuggacguagaccuacgcccagcuucagccuggacccucuaugcaguagccacaacaguuaucacucccaugaugagacacacaauugaaaacacaacagcaaacauuucccugacagccauugcaaaccaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaguuaggccaaauaauguuacugauacuuuguacaucacagauucucuugaugcggaccacaugggcccugugugaauccaucacacuggccacuggacccuugaccacucucugggagggaucuccaggaaaauucuggaauaccacaauagcaguguccauggcaaauaucuucaggggaaguuaucuagcaggagcaggucuggccuucucauuaaugaaaucuuugggaggaggcaggagagguacgggggcucaaggagaaacacugggagagaaauggaaaagacaguuaaaccaacugagcaagucagaauucaacaccuacaaaaggagugggauuauggagguggacagauccgaagccaaagagggauuaaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagucaagggauacacaaaaggaggaccuggacaugaggaaccuaucccaauggcgaccuauggauggaaccuaguaaagcuauacucuggaaaagauguauuuuuuacaccaccugagaaaugugauacccuucugugugauauaggagaguccucuccgaauccaacuauagaagaaggaagaacguuacguguucuaaagaugguagaaccauggcucagaggaaaccaauucugcauaaaaauucuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaaugacucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaagacaauccauacaaaacaugggccuaucauggaucauaugaggucaaaccaucaggaucagccucaucuauggugaauggcguggugagauugcucacaaaaccaugggaugucauccccauggucacacaaauagcuaugaccgauaccacacccuucggacaacagagaguguuuaaagagaaaguagauacgcgcacgccgagagcaaaacgaggcacagcacaaauuauggaggugacagccaaguggcuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggaacuucauaaacagggaaaaugugccacgugugucuacaacaugauggggaagagagagaaaaaauugggagaguuuggaaaggcaaaaggaagucgugcaauaugguacauguggcugggagcacgcuuucuagaguucgaagcccuugguuucaugaaugaagaucacugguucaguagagagaauucauucaguggaguggaaggagaaggacugcacaaacuuggauacauacucagagacauaucaaagaucccggggggaaacauguaugcagaugacacagccggaugggacacaagaauaacagaggaugaucuucagaaugaggccaaaaucacugacaucauggagccugaacacgcucuauuagcuacgucaauuuuuaagcugaccuaccaaaacaaggugguaagggugcaaagaccagcaaaaaauggaaccgugauggauguuauauccagacgagaccagagaggaagugggcaggucggaacuuauggcuuaaauacuuucaccaauauggagguccaacuaauaagacaaauggagucugaaggaaucuuuuuacccagcgaauuggaaacccccaaucuagcugagagaguucuuaacugguuggaaaaacauggcacugaaaggcugaaaagaauggcaauuagcggagaugauuguguggugaaaccaguugaugacagguuugcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccuaagacuagcggcuaaugcuaucuguucagcugucccaguugacuggguuccaaccagccgcacaaccuggucaauccaugcucaccaucaauggaugacaacagaagauauguuaucaguguggaauaggguuuggauagaggaaaacccauggauggaggauaaaacucauguguccagcugggaagaagucccauacuuagggaaaagggaagaucaaugguguggaucccugauaggcuugacagcgagggccacuugggccacuaacauacaaguggccauaaaccaagugagaaggcucaucggaaaugagaauuaucuagauuacaugacaucaaugaagagauucaagaaugagagugaucccgaaggggcacucugguaa

SEQ ID NO: 5570 - RNA, 9879 nt, Artificial Sequence
  derived and/or modified CDS sequence (wt) from DENV-1__FJ205872__SS-prME
ucugugaccaugcuccucaugcugcugcccacagcccuggcguuccauuugacuacacgagggggagagccacacaugauaguuaguaagcaggaaagaggaaagucacuguuguuuaagaccucugcaggcaucaauaugugcacucucauugcgauggaucugggagaguuaugcgaggacacaaugaccuacaaaugcccccggaucacugaggcggaaccagaugacguugacugcuggugcaaugccacagacacaugggugaccuaugggacauguucucaaaccggcgaacaccgacgagacaaacguuccguggcacuggccccacacgugggacuuggucuagaaacaagaaccgaaacauggauguccucugaaggugccuggaaacaaauacaaaaaguggagacuugggcuuugagacacccaggauucacggugacagccuuuuuuuuagcacaugccauaggaacauccauuacucagaaagggaucauuuucauuuugcugaugcuaguaacaccaucaauggccaugcgaugugugggaauaggcaacagggacuucguugaaggacugucaggagcaacguggguggacgugguauuggagcauggaagcugcgucaccaccauggcaaaagauaaaccaacauuggacauugaacucuugaagacggaggucacaaacccugccgucuugcgcaaacugugcauugaagcuaaaauaucaaacaccaccaccgauucaagguguccaacacaaggagaggccacacugguggaagaacaagacucgaacuuugugugucgacgaacguuuguggacagaggcugggguaauggcugcggacuauuuggaaaaggaagccuacugacgugugcuaaguucaagugugugacaaaacuagaagggaagauaguucaauaugaaaacuuaaaauauucagugauagucacuguccacacuggggaccagcaccaggugggaaacgagacuacagaacauggaacaauugcaacuauaacaccucaagcuccuacgucggaaauacagcugacugacuacggagcccucacauuggacugcucaccuagaacagggcuggacuuuaaugagaugguucuauugacaaugaaagaaaaaucauggcuuguccacaaacaaugguuucuagacuuaccacugccuuggacuucaggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacgaucuuugcaggacaccugaaaugcagacuaaaaauggauaaacugacuuuaaaaggaaugucauauguaaugugcacaggcucauuuaagcuagagaaggaaguggcugagacccagcauggaacuguucuagugcagguuaaauacgaaggaacagaugcgccaugcaagaucccuuuuucggcccaagaugagaaaggagugacccagaaugggagauugauaacagccaaccccauagucacugacaaagaaaaaccagucaacauugagacagaaccaccuuuuggugagagcuacaucgugguaggggcaggugaaaaagcuuugaaacugagcugguucaagaaagggagcagcauagggaaaauguucgaagcaacugcccgaggagcacgaaggauggcuauccugggagacaccgcaugggacuuuggcucuauaggaggaguguucacaucagugggaaaauugguacaccagguuuuuggagccgcauaugggguucuguucagcgguguuuccuggaccaugaaaauaggaauagggauucugcugacaugguugggauuaaauucaaggagcacgucacuuucgaugacgugcauugcgguuggcauggucacacuguaccuaggagucaugguucaagcggacucgggauguguaaucaacuggaagggcagagaacucaaauguggaagugguauuuuugucacuaaugaaguccacacuuggacagagcaauacaaauuccaggcugacuccccaaaaagacugucagcagccauugggaaggcaugggaagagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacauagauacucauggaaaagcuggggaaaagccaaaaucauaggagcagacauacagaauagcaccuucaucaucgacggcccagauacuccagaaugccccgaugaccaaagagcguggaacauuugggaaguugaagacuauggguuuggaauuuucacgacaaacauauggcugaaauugcgcgacuccuacacccaaaugugugaccaccggcuaauguccgcugccaucaaagacagcaaagcaguccaugcugacaugggguacuggauagaaagugaaaagaacgagaccuggaagcuagcgagagccuccuucauagaagucaagacauguaucuggccgaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuucgacuugugugaagguaccacaguuguuguggaugaacauuguggaaaucgaggcccaucucucagaacuacaacagucacaggaaagauaauccaugaaugguguugcagauccugcacguuaccccccuuacgcuucagaggagaagacggauguugguauggcauggaaaucagaccaguuaaggagaaggaggaaaaccuaguuaggucgauggucucugcagggucaggagaaguggacaguuuuucacuagggauacuaugcguaucaauaaugauugaagaagugaugagauccagauggaguagaaagaugcugaugacuggaacauuggcuguuuuccuccuucuuauaaugggacaacugacauggaaugaccugauuagguuaugcaucaugguuggagcuaaugcuucagacaggauggggaugggaacaacguaccuggccuugauggcuacuuucaaaaugagaccaauguucgcuguugggcuacuauuucgcagacuaacauccagagaaguucuucuucucacgauuggauuaagccugguagcauccguggaguuaccaaauucuuuggaggagcuaggggauggacuugcaauggguaucaugauguuaaaauuauugacugaauuucagccacaccaguuauggaccaccuuacugucuuugacauuuaucaaaacaacucuuucauuggauuaugcauggaggacaauggcuauggugcugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuuaaaaaugaugugccguuggccggcccacuaauagcuggaggcaugcuaauagcauguuaugucauauccggaagcucagccgauuuaucauuggagaaagcggcugagguauccugggaagaagaagcagaacacucugguaccucacacaacauauuaguagagguccaagaugauggaacuaugaaaauaaaagaugaagagagggaugacacacucaccauacuccucaaagcaacucugcuggcagucucaggaguguacccaaugucaauaccagcaacucuuuucgugugguauuuuuggcagaaaaagaaacagagaucaggaguguuaugggacacacccagcccuccggaaguggaaagagcaguucuugaugauggcaucuauagaauccugcaaagaggacuguugggcaggucccaagugggagugggaguuuuccaggacggcguguuccacacaauguggcacgucaccaggggagcuguccuuauguaccaagggaagagguuggaaccaagcugggccagugucaaaaaggacuugaucucauauggaggagguuggagauuucaaggaucauggaacacgggagaagaggugcaggugauagccguugaaccaggaaaaaauccuaaaaauguacagacaacgccggguaccuucaagacucccgaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaaacaucacaagaagggccucuaccagagauugaggaggagguguuuaagaaaaggaacuuaacaauaauggaccugcauccaggaucgggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacucgaguggguaugggugaagcagcugcgaucuuuaugacagccacucccccaggaucgguggaggccuuuccacaaaguaaugcaguuauccaagaugaggaaagagacauuccugagagaucauggaacucaggcuacgacuggaucacugauuuuccagguaaaacagucugguuuguuccaagcauuaagucaggaaaugacauugcuaacuguuuaagaaagaacggaaaacgggugauccaauugagcagaaaaaccuuugacacugaguaccagaaaacaagaaacaaugacugggacuauguugucacaacagacauuuccgaaaugggggcaaauuuccgggccgauaggguaauagacccaaggcggugcuugaaaccagugauacuaaaagaugguccagagcgugucauucuagccggaccgaugccagugacuguggccagugcugcccagagaagaggaagaauuggaaggaaccaaaacaaggaaggugaucaguacguuuauaugggacagccuuuaaauaaugaugaggaucacgcucauuggacagaagcaaaaaugcuccuugacaauauaaacacuccagaagggaucauuccagcccucuuugagccagagagagaaaagagugcagcaauagauggagaguacagacugcggggagaagcaaggaaaacguucguggagcucaugagaagaggagaucuaccaguuuggcuauccuacaaaguugccucagaagguuuccaguacuccgacagaagguggugcuuugacggggaaaggaacaaccagguguuggaggagaacauggacguggagaucuggacaaaggaaggagaaaggaagaaauugcgaccccgcugguuggaugccagaacauacucugauccacuggcccuucgugaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugcgcugacugguggagugacgcuguucuuccuaucaggaaaaggucuagggaaaacauccauuggccugcucugugugauggccucaagcgcacuguuauggauggccaauguggagccacauuggauagcggccuccaucauacuagaauucuuucugauggugcugcucauuccagagccagacagacagcgcacuccacaggacaaccagcuagcauacguggugauagguuuguuauucaugauacugacaguggcagccaaugagaugggauuauuggaaaccacaaagaaagaccuggggauuggcuauguagccgccgaaaaccaacaccaugccacgaugcuggacguagaccugcgcccagcuucagccuggacccucuaugcaguagccacaacaguuaucacucccaugaugagacacacaauugaaaacacaacagcaaacauuucccugacagccauugcaaaccaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacggcggccggaauaaugaaaaauccaaccguagacgggauuguugcaauagacuuggauccugugguuuaugaugcaaaauuugaaaaacaguuaggccaaauaauguuacugauacuuuguacaucacagauucucuugaugcggaccacaugggcccugugugaauccaucacacuggcuacuggacccuugaccacucucugggagggaucuccaggaaaauucuggaauaccacgauagcaguguccauggcaaacaucuucaggggaaguuaucuagcaggagcaggucuggccuucucguuaaugaaaucuuugggaggaggcaggagagguacgggggcucaaggagaaacacugggagagaaauggaaaagacagcuaaaccaacugagcaagucagaauucaacaccuacaaaaggagugggauuauggagguggacagauccgaagccaaagagggauuaaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagucaagggauacacaaaaggaggaccuggacaugaggaaccuaucccaauggcgaccuauggauggaaccuaguaaagcuauacucuggaaaagauguauuuuuuacaccaccugagaaaugugauacccuucugugugauauaggagaguccucuccgaauccaacuauagaagaaggaagaacguuacguguucuaaagaugguagaaccauggcucagaggaaaccaauucugcauaaaaauucuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaaugacucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaagacaauccauacaaaacaugggccuaucauggaucauaugaggucaaaccaucaggaucagccucaucuauggugaauggcguggugagauugcucacaaaaccaugggaugucauccccauggucacacaaauagcuaugaccgauaccacacccuucggacaacagagaguguuuaaagagaaaguagauacgcgcacgccgagagcaaaacgaggcacagcacaaauuauggaggugacagccaaguggcuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggaacuucauaaacagggaaaaugugccacgugugucuacaacaugauggggaagagagagaaaaaauuaggagaguuuggaaaggcaaaaggaagucgugcaauaugguacauguggcugggagcacgcuuucuagaguucgaagcccuugguuucaugaaugaagaucacugguucaguagagagaauucauucaguggaguggaaggagaaggacugcacaaacuuggauacauacucagagacauaucaaagaucccggggggaaacauguaugcagaugacacagccggaugggacacaagaauaacagaggaugaucuucagaaugaggccaaaaucacugacaucauggagccugaacacgcucuauuagcuacgucaauuuuuaagcugaccuaccaaaacaaggugguaagggugcaaagaccagcaaaaaauggaaccgugauggauguuauauccagacgagaccagagaggaagugggcaggucggaacuuauggcuuaaauacuuucacuaauauggagguccaacuaauaagacaaauggagucugaaggaaucuuuuuacccagcgaauuggaaacccccaaucuagcugagagaguucuuaacugguuggaaaaacauggcacugaaaggcugaaaagaauggcaauuagcggagaugauuguguggugaaaccaguugaugacagguuugcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccuaagacuagcggcuaaugcuaucuguucagcugucccaguugacuggguuccaaccagccgcacaaccuggucaauccaugcucaccaucaauggaugacaacagaagauauguuaucaguguggaauaggguuuggauagaggaaaacccauggauggaggauaaaacucauguguccagcugggaagaagucccauacuuagggaaaagggaagaccaaugguguggaucccugauaggcuugacagcgagggccacuugggccacuaacauacaaguggccauaaaccaagugagaaggcucaucggaaaugagaauuaucuagauuacaugacaucaaugaagagauucaagaaugagagugaucccgaaggggcacucugguaa

SEQ ID NO: 5571 - RNA, 9879 nt, Artificial Sequence
  derived and/or modified CDS sequence (wt) from DENV-1__FJ205873__SS-prME
ucugugaccaugcuccucaugcugcugcccacagcccuggcguuccauuugaccacacgagggggagagccacacaugauaguuaguaagcaggaaagaggaaagucacuguuguuuaagaccucugcaggcaucaauaugugcacucucauugcgauggauuugggagaguuaugcgaggacacaaugaccuacaaaugcccccggaucacugaggcggaaccagaugacguugacugcuggugcaaugccacagacacaugggugaccuaugggacauguucucaaaccggcgaacaccgacgagacaaacguuccguggcacuggccccacacgugggacuuggucuagaaacaagaaccgaaacauggauguccucugaaggugccuggaaacaaauacaaaaaguggagacuugggcuuugagacacccaggauucacggugacagcccuuuuuuuagcacaugccauaggaacauccauuacucagaaagggaucauuuucauuuugcugaugcuaguaacaccaucaauggccaugcgaugugugggaauaggcaacagggacuucguugaaggacugucaggagcaacguggguggacgugguauuggagcauggaagcugcgucaccaccauggcaaaagauaaaccaacauuggacauugaacucuugaagacggaggucacaaacccugccgucuugcgcaaacuguguauugaagcuaaaauaucaaacaccaccaccgauucaagguguccaacacaaggagaggccacacugguggaagaacaagacucgaacuuugugugucgacgaacguuuguggacagaggcugggguaauggcugcggacuauuuggaaaaggaagccuacugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcaacuauaacaccucaagcuccuacgucggaaauacagcugacugacuacggagcccucacauuggacugcucaccuagaacagggcuggacuuuaaugagaugguucuauugacaaugaaagaaaaaucauggcuuguccacaaacaaugguuucuagacuuaccacugccuuggacuucaggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacgaucuuugcaggacaccugaaaugcagacuaaaaauggauaaacugacuuuaaaagggaugucauauguaaugugcacaggcucauuuaagcuagagaaggaaguggcugagacccagcauggaacuguucuagugcagguuaaauacgaaggaacagaugcgccaugcaagaucccuuuuucggcccaagaugagaaaggagugacccagaaugggagauugauaacagccaaccccauagucacugacaaagaaaaaccagucaacauugagacagaaccaccuuuuggugagagcuacaucgugguaggggcaggugaaaaagcuuugaaacugagcugguucaagaaagggagcagcauagggaaaauguucgaagcaacugcccgaggagcacgaaggauggcuauccugggagacaccgcaugggacuuuggcucuauaggaggaguguucacaucagugggaaaauugguacaccagguuuuuggagccgcauaugggguucuguucagcgguguuucuuggaccaugaaaauaggaauagggauucugcugacaugguugggauuaaauucaaggagcacgucacuuucgaugacgugcauugcgguuggcauggucacacuguaccuaggagucaugguucaagcggacucgggauguguaaucaacuggaaaggcagagaacucaaauguggaagugguauuuuugucaccaaugaaguccacacuuggacagagcaauacaaauuccaggcugacuccccaaaaagacugucagcagccauugggaaggcaugggaagagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacauagauacucauggaaaagcuggggaaaagccaaaaucauaggagcagacauacagaauagcaccuucaucaucgacggcccagauacuccagaaugccccgaugaccaaagagcguggaacauuugggaaguugaagacuauggguuuggaauuuucacgacaaacauauggcugaaauugcgcgacuccuacacccaaaugugugaccaccggcuaauguccgcugccaucaaagacagcaaggcaguccaugcugacaugggguacuggauagaaagugaaaagaacgagaccuggaagcuagcgagagccuccuucauagaagucaagacauguaucuggccgaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgaggcccaucucucagaacuacaacagucacaggaaagauaauccaugaauggugcugcagauccugcacguuaccccccuuacgcuucagaggagaagacggauguugguauggcauggaaaucagaccaguuaaggagaaggaggaaaaccuaguuaggucaauggucucugcagggucaggagaaguggacaguuuuucacuagggauacuaugcguaucaauaaugauugaagaagugaugagauccagauggaguagaaagaugcugaugacuggaacauuggcuguuuuccuccuucuuauaaugggacaacugacauggaaugaccugauuagguuaugcaucaugguuggagcuaaugcuucagacaggauggggaugggaacaacguaccuggccuugauggcuacuuucaaaaugagaccaauguucgcuguugggcuacuauuucgcaaacuaacauccagagaaguucuucuucucacgauuggauuaagccugguggcauccguggaguuaccaaauucuuuggaggagcuaggggauggacuugcaauggguaucaugauguuaaaauuauugacugaauuucagccacaccaguuauggaccaccuuacugucuuugacauuuaucaaaacaacucuuucauuggauuaugcauggaggacaauggcuauggugcugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuuaaaaaugaugugccguuggccggcccacuaauagcuggaggcaugcuaauagcauguuaugucauauccggaagcucagccgauuuaucauuggagaaagcggcugagguauccugggaagaagaagcagaacauucugguaccucacacaacauauuaguagagguccaagaugauggaacuaugaaaauaaaggaugaagagagggaugacacacucaccauacuccucaaagcaacuuugcuggcagucucaggaguguacccaaugucaauaccagcaacucuuuucgugugguauuuuuggcagaaaaagaaacagagaucaggaguguuaugggacacacccagcccuccggaaguggaaagagcaguucuugaugauggcaucuauagaauccugcaaagaggacuguugggcaggucccaaguaggagugggaguuuuccaggacggcguguuccacacaauguggcacgucaccaggggagcuguccuuauguaccaagggaagagguuggaaccaagcugggccagugucaaaaaggacuugaucucauauggaggagguuggagauuucaaggaucauggaacacgggagaagaggugcaggugauagccguugaaccaggaaaaaauccuaaaaauguacagacaacgccggguaccuucaagacucccgaaggcgaaguuggagcuauagcucuagauuuuaaacccggcacaucuggaucucccaucgugaacagagagggaaaaguaguaggucuuuauggaaauggaguggugacaacaaguggaaccuaugucagugccauugcccaagcuaaaacaucacaagaagggccucuaccagagauugaggaggagguguuuaagaaaaggaacuuaacaauaauggaccugcauccaggaucgggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacucgaguggguaugggugaagcagcugcgaucuuuaugacagccacucccccaggaucgguggaggccuuuccacaaaguaaugcaguuauccaagaugaggaaagagacauuccugagagaucauggaauucaggcuacgacuggaucacugauuuuccagguaaaacagucugguuuguuccaagcauuaagucaggaaaugacauugcuaacuguuuaagaaagaacggaaaacgggugauccaauugagcagaaaaaccuuugacacugaguaccagaaaacaagaaacaaugacugggacuauguugucacaacagacauuuccgaaaugggggcaaauuuccgggccgacaggguaauagacccaaggcggugcuugaaaccagugauacuaaaagaugguccagagcgugucauucuagccggaccgaugccagugacuguggccagugcugcccagagaagaggaagaauuggaaggaaccaaaacaaggaaggugaucaguacguuuauaugggacagccuuuaaauaaugaugaggaucacgcucauuggacagaagcaaaaaugcuccuugacaauauaaacacaccagaagggaucauuccagcccucuuugagccagagagagaaaagagugcagcaauagauggggaguacagacugcggggagaagcaaggaaaacguucguggagcucaugagaagaggagaucuaccaguuuggcuauccuacaaaguugccucagaagguuuccaguacuccgacagaagguggugcuuugacggggaaaggaacaaccagguguuggaggagaacauggacguggagaucuggacaaaggaaggagaaaggaagaaauugcgaccccgcugguuggaugccagaacauacucugauccacuggcccuucgugaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggagggaaagccuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggacaaccagcuagcauacguggugauagguuuguuauucaugauacugacaguggcagccaaugagaugggauuauuggaaaccacaaagaaagaccuggggauuggccauguagccgccgaaaaccaacaccaugccacgaugcuggacguagaccuacgcccagcuucagccuggacccucuaugcaguagccacaacaguuaucacucccaugaugagacacacaauugaaaacacaacagcaaacauuucccugacagccauugcaaaccaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaguuaggccaaauaauguuacugauacuuuguacaucacagauucucuugaugcggaccacaugggcccugugugaauccaucacacuggcuacuggacccuugaccacucucugggagggaucuccaggaaaauucuggaauaccacgauagcaguguccauggcaaacaucuucaggggaaguuaucuagcaggagcaggucuggccuucucguuaaugaaaucuuugggaggaggcaggagagguacgggggcucaaggagaaacacugggagagaaauggaaaagacaguuaaaccaacugagcaagucagaauucaacaccuacaaaaggagugggauuauggagguggacagauccgaagccaaagagggauuaaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagucaagggauacacaaaaggaggaccuggacaugaggaaccuaucccaauggcgaccuauggauggaaccuaguaaagcuauacucuggaaaagauguauuuuuuacaccaccugagaaaugugauacccuucugugugauauaggagaguccucuccgaauccaacuauagaagaaggaagaacguuacguguucuaaagaugguagaaccauggcucagaggaaaccaauucugcauaaaaauucuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaaugacucacaggaagccaacauaugaaagagauguggacuuaggcgcuggaacaagacauguggcaguggaaccagagguagccaaccuagauauuauuggccagaggauagagaauauaaaaaaugaacacaagucaacauggcauuaugaugaagacaauccauacaaaacaugggccuaucauggaucauaugaggucaaaccaucaggaucagccucaucuauggugaauggcguggugagauugcucacaaaaccaugggaugucauccccauggucacacaaauagccaugaccgauaccacacccuucggacaacagagaguguucaaagagaaaguagauacgcgcacgccgagagcaaaacgaggcacagcacaaauuauggaggugacagccaaguggcuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggaacuccauaaacagggaaaaugugccacgugugucuacaacaugauggggaagagagagaaaaaauugggagaguuuggaaaggcaaaaggaagucgugcaauaugguacauguggcugggagcacgcuuucuagaguucgaagcccuugguuucaugaaugaagaucacugguucaguagagagaauucauucaguggaguggaaggagaaggacugcacaaacuuggauacauacucagagacauaucaaagaucccggggggaaacauguaugcagaugacacagccggaugggacacaagaauaacagaggaugaucuucagaaugaggccaaaaucacugacaucauggagccugaacacgcucuauuagcuacgucaauuuuuaagcugaccuaccaaaacaaggugguaagggugcaaagaccagcaaaaaauggaaccgugauggauguuauauccagacgagaccagagaggaagugggcaggucggaaccuauggccuaaacacuuucaccaauauggagguccaacuaauaagacaaauggagucugaaggaauuuuuuuacccagcgaauuggaaacccccaaucuagcugagagaguucuuaacugguuggaaaaacaugguacugaaaggcugaaaagaauggcaauuagcggagaugauuguguggugaaaccaguugaugacagguuugcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccuaagacuagcggcuaaugcuaucuguucagcugucccaguugacuggguuccaaccagccgcacaaccuggucaauccaugcucaccaucaauggaugacaacagaagauauguuaucaguguggaauaggguuuggauagaggaaaacccauggauggaggauaaaacucauguauccagcugggaagaagucccauacuuaggaaaaagggaagaucaaugguguggaucccugauaggcuugacagcgagggccacuugggccacuaacauacaaguagccauaaaccaagugagaaggcuuaucggaaaugagaauuaucuagauuacaugacaucaaugaagagauucaagaaugagagugaucccgaaggggcacucugguaa

SEQ ID NO: 5572 - RNA, 9879 nt, Artificial Sequence
  derived and/or modified CDS sequence (wt) from DENV-1__FJ390379__SS-prME
ucugugaccaugcuccucaugcugcugccuacagcccuggcguuccauuugaccacacgagggggagagccacacaugauaguuaguaagcaggaaagaggaaagucacuguuguuuaagaccucugcaggcaucaauaugugcacucucauugcgauggauuugggagaguuaugcgaggacacaaugaccuacaaaugcccccggaucacugaggcggaaccagaugacguugacugcuggugcaaugccacagacacaugggugaccuaugggacauguucucaaaccggcgaacaccgacgagacaaacguuccguggcacuggccccacacgugggacuuggucuagaaacaagaaccgaaacauggauguccucugaaggugccuggaaacaaauacaaaaaguggagacuugggcuuugagacacccaggauucacggugacagcccuuuuuuuagcacaugccauaggaacauccauuacucagaaagggaucauuuucauuuugcugaugcuaguaacaccaucaauggccaugcgaugugugggaauaggcaacagggacuucguugaaggacugucaggagcaacguggguggacgugguauuggagcauggaagcugugucaccaccauggcaaaagauaaaccaacauuggacauugaacucuugaagacggaggucacaaacccugccgucuugcgcaaacugugcauugaagcuaaaauaucaaacaccaccaccgauucaagguguccaacacaaggagaggccacacugguggaagaacaagacucgaacuuugugugucgacgaacguuuguggacagaggcugggguaauggcugcggacuauuuggaaaaggaagccuacugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcaacuauaacaccucaagcuccuacgucggaaauacagcugacugacuacggagcccucacauuggacugcucaccuagaacagggcuggacuuuaaugagaugguucuauugacaaugaaagaaaaaucauggcuuguccacaaacaaugguuucuagacuuaccacugccuuggacuucaggagcuucaacaucccaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaaagggaugucauauguaaugugcacaggcucauuuaagcuagagaaggaaguggcugagacccagcauggaacuguucuagugcagguuaaauacgaaggaacagaugcgccaugcaaaaucccuuuuucggcccaagaugagaaaggagugacccagaaugggagauugauaacagccaaccccauagucacugacaaagaaaaaccagucaacauugagacagaaccaccuuuuggugagagcuacaucgugguaggggcaggugaaaaagcuuugaaacugagcugguucaagaaagggagcagcauagggaaaauguucgaagcaacugcccgaggagcacgaaggauggcuauccugggagacaccgcaugggacuuuggcucuauaggaggaguguucacaucagugggaaaauugguacaccagguuuuuggagccgcauaugggguucuguucagcgguguuucuuggaccaugaaaauaggaauagggauccugcugacaugguugggauuaaauucaaggagcacgucacuuucgaugacgugcauugcgguuggcauggucacacuguaccuaggagucaugguucaagcggacucgggauguguaaucaacuggaagggcagagaacucaaauguggaagugguauuuuugucacuaaugaaguccacacuuggacagagcaauacaaauuccaggcugacuccccaaaaagacugucagcagccauugggaaagcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggagaaaaaugauuaggccacaacccauggaacauagauacucauggaaaagcuggggaaaagccaaaaucauaggagcagacauacagaauagcaccuucaucaucgacggcccagauacuccagaaugccccgaugaccaaagagcguggaacauuugggaaguugaagacuauggguuuggaauuuucacgacaaacauauggcugaaauugcgcgacuccuacacccaaaugugugaccaccggcuaauguccgcugccaucaaagacagcaaggcaguccaugcugacaugggguacuggauagaaagugaaaagaacgagaccuggaagcuagcgagagccuccuucauagaagucaagacauguaucuggccgaaaucccacacucuauggaguaauggaguuuuggaaagugaaaugauaaucccaaagauauauggaggaccaauaucucagcacaacuacagaccaggguauuucacacaaacagcagggccguggcaccuaggcaaguuggaauuggauuuugacuugugugaagguaccacaguuguuguggaugaacauuguggaaaucgaggcccaucucucagaacuacaacagucacaggaaagauaauccaugaaugguguugcagauccugcacguuaccccccuuacgcuucagaggagaagacggauguugguauggcauggaaaucagaccaguuaaggagaaggaggaaaaccuaguuaggucaauggucucugcagggucaggagaaguggacaguuuuucacuagggauacuaugcguaucaauaaugauugaagaagugaugagauccagauggaguagaaagaugcugaugacuggaacauuggcuguuuuccuccuucuuauaaugggacaacugacauggaaugaccugauuagguuaugcaucaugguuggagcuaaugcuucagacaggauggggaugggaacaacguaccuggcuuugauggcuacuuucaaaaugagaccaauguucgcuguugggcuacuauuucgcagauuaacauccagagaaguucuucuucucacgauuggauuaagccugguggcauccguggaguuaccaaauucuuuggaggagcuaggggauggacuugcaauggguaucaugauguuaaaauuauugacugaauuucagccacaccaguuauggaccaccuuacugucuuugacauuuaucaaaacaacucuuucauuggauuaugcauggaggacaauggcuauggugcugucaaucguaucucucuuucccuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggccauuggaauagucagcauucuacuaaguucacuccuuaaaaaugaugugccguuggccggcccacuaauagcuggaggcaugcuaauagcauguuaugucauauccggaagcucagccgauuuaucauuggagaaagcggcugagguauccugggaagaagaagcagaacacucugguaccucacacaacauauuaguagagguccaagaugauggaacuaugaaaauaaaagaugaagagagggaugacacacucaccauacuccucaaagcaacucugcuggcaaucucaggaguguacccaaugucaauaccagcaacucuuuucgugugguauuuuuggcagaaaaagaaacagagaucaggaguguuaugggacacacccagcccuccggaaguggaaagagcaguucuugaugauggcaucuauagaauccugcaaagaggacuguugggcaggucccaagugggagugggaguuuuccaggacggcguguuccacacaauguggcacgucaccaggggagcuguccuuauguaccaagggaagagguuggaaccaagcugggccagugucaaaaaggacuugaucucauauggaggagguuggagauuucaaggaucauggaacacgggagaagaggugcaggugauagccguugaaccaggaaaaaauccuaaaaauguacagacaacgccggguaccuucaagacucccgaaggcgaaguuggagccauagcccuagauuuuaaacccggcacaucuggaucucccaucgugaacagagagggaaaaauaguaggucuuuauggaaauggaguggugacaacaaguggaaccuacgucagugccauugcccaagcuaaaacaucacaagaagggccucuaccagagauugaggaggagguguuuaagaaaaggaacuuaacaauaauggaccugcauccaggaucgggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacucgaguggguaugggugaagcagcugcgaucuuuaugacagccacucccccaggaucgguggaggccuuuccacaaaguaaugcaguuauccaagaugaggaaagagacauuccugagagaucauggaacucaggcuacgacuggaucacugauuuuccagguaaaacagucugguuuguuccaagcauuaagucaggaaaugacauugcuaacuguuuaagaaagaacggaaaacgggugauccaauugagcagaaaaaccuuugacacugaguaccagaaaacaagaaacaaugacugggacuauguugucacaacagacauuuccgaaaugggggcaaauuuccgggccgacaggguaauagacccaaggcggugcuugaaaccagugauacuaaaagaugguccagagcgugucauucuagccggaccgaugccagugacuguggccagugcugcccagagaagaggaagaauuggaaggaaccaaaacaaggaaggugaucaguacguuuauaugggacagccuuuaaauaaugaugaggaucacgcucauuggacagaagcaaaaaugcuccuugacaauauaaacacaccagaagggaucauuccagcccucuuugagccagagagagaaaagagugcagcaauagauggggaguacagacugcggggagaagcaaggaaaacguucguggagcucaugagaagaggagaucuaccaguuuggcuauccuacaaaguugccucagaagguuuccaguacuccgacagaagguggugcuuugacggggaaaggaacaaccagguguuggaggagaacauggacguggagaucuggacaaaggaaggagaaaggaagaaauugcgaccccgcugguuggaugccagaacauacucugauccacuggcccuucgugaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggacaaccagcuagcauacguggugauagguuuguuauucaugauacuaacaguggcagccaaugagaugggauuauuggaaaccacaaagaaagaccuggggauuggccauguagccgccgaaaaccaacaccaugccacgaugcuggacguagaccuacgcccagcuucagccuggacccucuaugcaguagccacaacaguuaucacucccaugaugagacacacaauugaaaacacaacagcaaacauuucccugacagccauugcaaaccaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaguuaggccaaauaauguuacugauacuuuguacaucacagauucucuugaugcggaccacaugggcccugugugaauccaucacacuggcuacuggacccuugaccacucucugggagggaucuccaggaaaauucuggaauaccacgauagcaguguccauggcaaacaucuucaggggaaguuaucuagcaggagcaggucuggccuucucguuaaugaaaucuuugggaggaggcaggagagguacgggggcucaaggagaaacacugggagagaaauggaaaagacaguuaaaccaacugagcaagucagaauucaacaccuacaaaaggagugggauuauggagguggacagauccgaagccaaagagggauuaaaaagaggagaaacaaccaaacaugcagugucgagaggaacagccaaacugaggugguuuguggagaggaaccucgugaaaccagaagggaaagucauagaccucgguuguggaagagguggcuggucauauuauugugccgggcugaagaaagucacugaagucaagggauacacaaaaggaggaccuggacaugaggaaccugucccaauggcgaccuauggauggaaccuaguaaagcuauacucuggaaaagauguauuuuuuacaccaccugagaaaugugauacccuucugugugauauaggagaguccucuccgaauccaacuauagaagaaggaagaacguuacguguucuaaagaugguagaaccauggcucagaggaaaccaauucugcauaaaaauucuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaaugacucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaagacaauccauacaaaacaugggccuaucauggaucauaugaggucaaaccaucaggaucagccucaucuauggugaauggcguggugagauugcucacaaaaccaugggaugucauccccauggucacacaaauagccaugaccgauaccacacccuucggacaacagagaguguuuaaagagaaaguagauacgcgcacgccgagagcaaaacgaggcacagcacaaauuauggaggugacagccaaguggcuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggaacuucauaaacagggaaaaugugccacgugcgucuacaacaugauggggaagagagagaaaaaauugggagaguuuggaaaggcaaaaggaagucgugcaauaugguacauguggcugggagcacgcuuucuagaguucgaagcccuugguuucaugaaugaagaccacugguucaguagagagaauucauucaguggaguggaaggagaaggacugcacaaacuuggauacauacucagagacauaucaaagaucccggggggaaacauguaugcagaugacacagccggaugggacacaagaauaacagaggaugaucuucagaaugaggcuaaaaucacugacaucauggagccugaacacgcucuauuggcuacgucaauuuuuaagcugaccuaccaaaacaaggugguaagggugcaaagaccagcaaaaaauggaaccgugauggauguuauauccagacgagaccagagaggaagugggcaggucggaaccuauggcuuaaauacuuucaccaauauggagguccaacuaauaagacaaauggagucugaaggaaucuuuuuacccagcgaauuggaaacccccaaucuagcugagagaguucuugacugguuggaaaaacauggcacugaaaggcugaaaagaauggcaauuagcggagaugauuguguggugaaaccagucgaugacagguuugcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccuaagacuagcggcuaaugcuaucuguucagcugucccaguugacuggguuccaaccagccgcacaaccuggucaauccaugcucaccaucaauggaugacaacagaagauauguuaucaguguggaauaggguuuggauagaggaaaacccauggauggaggauaaaacucauguauccagcugggaagaagucccauacuuagggaaaagggaagaucaaugguguggaucccugauaggcuugacagcgagggccacuugggccacuaacauacaaguagccauaaaccaagugagaaggcucaucgggaaugagaauuaucuagauuacaugacaucaaugaagagauucaagaaugagagugaucccgaaggggcacucugguaa

SEQ ID NO: 5573 - RNA, 9879 nt, Artificial Sequence
  derived and/or modified CDS sequence (wt) from DENV-1__FJ390380__SS-prME
ucugugaccaugcuccucaugcugcugcccacagcccuggcauuccauuugaccacacgagggggagagccacacaugauaguuaguaagcaggaaagaggaaagucacuguuguuuaagaccucugcaggcaucaauaugugcacucucauugcgauggauuugggagaguuaugugaggacacaaugaccuacaaaugcccccggaucacugaggcggaaccagaugacguugacugcuggugcaaugccacagacacaugggugaccuaugggacauguucucaaaccggcgaacaccgacgagacaaacguuccguggcacuggccccacacgugggacuuggucuagaaacaagaaccgaaacauggauguccucugaaggugccuggaaacaaauacaaaaaguggagacuugggcuuugagacacccaggauucacggugacagcccuuuuuuuagcacaugccauaggaacauccauuacucagaaagggaucauuuucauuuugcugaugcuaguaacaccaucaauggccaugcgaugugugggaauaggcaacagggacuucguugaaggacugucaggagcaacguggguggacgugguauuggagcauggaagcugcgucaccaccauggcaaaagauaaaccaacauuggacauugaacucuugaagacggaggucacaaacccugccgucuugcgcaaacugugcauugaagcuaaaauaucaaacaccaccaccgauucaagguguccaacacaaggagaggccacacugguggaagaacaagacucgaacuuugugugucgacgaacguuuguggacagaggcugggguaauggcugcggacuauuuggaaaaggaagccuacugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcaacuauaacaccucaagcuccuacgucggaaauacagcugacugacuacggagcccucacauuggacugcucaccuagaacagggcuggacuuuaaugagaugguucuauugacaaugaaagaaaaaucauggcuuguccacaaacaaugguuucuagacuuaccacugccuuggacuucaggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacgaucuuugcaggacaccugaaaugcagacuaaaaauggauaaacugacuuuaaaagggaugucauauguaaugugcacaggcucauuuaagcuagagaaggaaguggcugagacccagcauggaacuguucuagugcagguuaaauacgaaggaacagaugcgccaugcaagaucccuuuuucggcccaagaugagaaaggagugacccagaaugggagauugauaacagccaaccccauagucacugacaaagaaaaaccagucaacauugagacagaaccaccuuuuggugagagcuacaucgugguaggggcaggugaaaaagcuuugaaacugagcugguucaagaaagggagcagcauagggaaaauguucgaagcaacugcccgaggagcacgaaggauggcuauccugggagacaccgcaugggacuuuggcucuauaggaggaguguucacaucagugggaaaauugguacaccagguuuuuggagccgcauaugggguucuguucagcgguguuucuuggaccaugaaaauaggaauagggauucugcugacaugguugggauuaaauucaaggagcacgucacuuucgaugacgugcauugcgguuggcauggucacacuguaccuaggagucaugguucaagcggacucgggauguguaaucaacuggaaaggcagagaacucaaauguggaagugguauuuuugucaccaaugaaguccacacuuggacagagcaauacaaguuccaggcugacuccccaaaaagacugucagcagccauugggaaggcaugggaagagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccagggaaaaaaaaugauuaggccacaacccauggaacauagauacucauggaaaagcuggggaaaagccaaaaucauaggagcagacauacagaauagcaccuucaucaucgacggcccagauacuccagaaugccccgaugaccaaagagcguggaacauuugggaaguugaagacuauggguuuggaauuuucacgacaaacauauggcugaaauugcgcgacuccuacacccaaaugugugaccaccggcuaauguccgcugccaucaaagacagcaaggcaguccaugcugacaugggguacuggauagaaagugaaaagaacgagaccuggaagcuagcgagagccuccuucauagaagucaagacauguaucuggccgaaaucccacacucuauggaguaauggaguuuuggaaagugaaaugauaaucccaaagauauacggaggaccaauaucucagcacaacuacagaccaggguauuucacacaaacagcaggaccauggcaccuaggcaaguuggaauuggauuuugaguugugugaagguaccacaguuguuguggaugaacauuguggaaaucgaggcccaucucucagaacuacaacagucacaggaaagauaauccaugaaugguguugcagauccugcacguuaccccccuuacgcuucagaggagaagacggauguugguauggcauggaaaucagaccaguuaaggagaaggaggaaaaccuaguuaggucaauggucucugcagggucaggagaaguggacaguuuuucacuagggauacuaugcguaucaauaaugauugaagaagugaugagauccagauggaguagaaagaugcugaugacuggaacauugguuguuuucuuccuucuuauaaugggacaacugacauggaaugaccugauuagguuaugcaucaugguuggagcuaaugcuucagacaggauggggaugggaacaacguaccuggccuugauggcuacuuucaaaaugagaccaauguucgcuguugggcuacuauuucgcagacuaacauccagagaaguucuucuucucacgauuggauuaagccugguggcauccguggaguuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuaugcauggaggacaauggcuauggugcugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuuaaaaaugaugugccguuggccggcccacugauagcuggaggcaugcuaauagcauguuaugucauauccggaagcucagccgauuuaucauuggagaaagcggcugagguauccugggaagaagaagcagaacacucugguaccucacacaacauauuaguagagguccaagaugauggaacuaugaaaauaaaggaugaagagagggaugacacacucaccauacuccucaaagcaacuuugcuggcagucucaggaguguacccaaugucaauaccagcaacuuuuuucgugugguauuuuuggcagaaaaagaaacagagaucaggaguguuaugggacacacccagcccuccggaaguggaaagagcaguucuugaugauggcaucuauagaauccugcaaagaggacuguugggcaggucccaaguaggagugggaguuuuccaggacggcguguuccacacaauguggcacgucaccaggggagcuguccuuauguaccaagggaagagguuagaaccaagcugggccagugucaaaaaggacuugaucucauauggaggagguuggagauuucaaggaucauggaacacgggagaagaggugcaggugauagccguugaaccaggaaaaaauccuaaaaauguacagacaacgccggguaccuucaagacucccgaaggcgaaguuggagccauagcucuagauuuuaaacccggcacaucuggaucucccaucgugaacagagagggaaaaauaguaggucuuuauggaaauggagugguaacaacaaguggaaccuacgucagugccauugcccaagcuaaaacaucacaagaagggccucuaccagagauugaggaggagguguuuaagaaaaggaacuuaacaauaauggaccugcacccaggaucgggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacucgaguggguaugggugaagcagcugcgaucuuuaugacagccacucccccaggaucgguggaggccuuuccacaaaguaaugcaguuauccaagaugaggaaagagacauuccugagagaucauggaacucaggcuacgacuggaucacugauuuuccagguaaaacagucugguuuguuccaagcauuaagucaggaaaugacauugcuaacuguuuaagaaagaacggaaaacgggugauccaauugagcagaaaaaccuuugacacugaguaccagaaaacaagaaacaaugacugggacuauguugucacaacagacauuuccgaaaugggggcaaauuuccgggccgacaggguaauagacccaaggcggugcuugaaaccagugauacuaaaagaugguccagagcgugucauucuagccggaccaaugccagugacuguggccagugcugcccagagaagaggaagaauuggaaggaaccaaaacaaggaaggugaucaguacguuuauaugggacagccuuuaaauaaugaugaggaucacgcucauuggacagaagcaaaaaugcuccuugauaauauaaacacaccagaagggaucauuccagcccucuuugagccagagagagaaaagagugcagcaauagauggggaguacagacugcggggagaagcaaggaaaacguucguggagcucaugagaagaggagaucuaccaguuuggcuauccuacaaaguugcuucagaagguuuccaguacuccgacagaagguggugcuuugacggggaaaggaacaaccagguguuggaggagaacauggacguggagaucuggacaaaggaaggagaaaggaagaaauugcgaccccgcugguuggaugccagaacauacucugauccacuggcccuucgugaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggauaaccagcuagcauacguggugauagguuuguuauucaugauacugacaguggcagccaaugagaugggauuauuggaaaccacaaagaaagaccuggggauuggccauguagccgccgaaaaccaacaccaugccacgaugcuggacguagaccuacgcccagcuucagccuggacccucuaugcaguagccacaacaguuaucacucccaugaugagacacacaauugaaaacacaacagcaaacauuucccugacagccauugcaaaccaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaguuaggucaaauaauguuacugauacuuuguacaucacagauucucuugaugcggaccacaugggcccugugugaauccaucacacuggcuacuggacccuugaccacucucugggagggaucuccaggaaaauucuggaauaccacgauagcaguguccauggcaaacaucuucaggggaaguuaucuagcaggagcaggucuggccuucucguuaaugaaaucuuugggaggaggcaggagagguacgggggcucaaggagaaacacugggagagaaauggaaaagacaguuaaaccaacugagcaagucagaauucaacaccuacaaaaggagugggauuauggagguggacagauccgaagccaaagagggauuaaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagucaagggauacacaaaaggaggaccuggacaugaggaaccuaucccaauggcgaccuauggauggaaccuaguaaagcuauacucuggaaaagauguauuuuuuacaccaccugagaaaugugauacccuucugugugauauaggagaguccucuccgaauccaacuauagaagaaggaagaacguuacguguucuaaagaugguagaaccauggcucagaggaaaccaauucugcauaaaaauucuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaaugacucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaagacaauccauacaaaacaugggccuaucauggaucauaugaggucaaaccaucaggaucagccucaucuauggugaauggcguggugagauugcucacaaaaccaugggaugucauccccauggucacacaaauagccaugaccgauaccacacccuucggacaacagagaguguuuaaagagaaaguagauacgcgcacgccgagagcaaaacgaggcacagcacaaauuauggaggugacagccaaguggcuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggaacuucauaaacagggaaaaugugccacgugugucuacaacaugauggggaagagagagaaaaaauugggagaguuuggaaaggcaaaaggaagucgugcaauaugguacauguggcugggagcacgcuuucuagaguucgaagcccuugguuucaugaaugaagaucacugguucaguagagagaauucauucaguggaguggaaggagaaggacugcacaaacuuggauacauacucagagacauaucaaagaucccggggggaaacauguaugcagaugacacagccggaugggacacaagaauaacagaggaugaucuucagaaugaggccaaaaucacugacaucauggagccugaacacgcucuauuagcuacgucaauuuuuaagcugaccuaccaaaacaaggugguaagggugcaaagaccagcaaaaaauggaaccgugauggauguuauauccagacgagaccagagaggaagugggcaggucggaaccuauggcuuaaauacuuucaccaauauggagguccaacuaauaagacaaauggagucugaaggaaucuuuuuacccagcgaauuggaaacccccaaucuagcugagagaguucuuaacugguuggaaaaacauggcacugaaaggcugaaaagaauggcaauuagcggagaugauuguguggugaaaccaguugaugacagguuugcaacagccuuaauagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccuaagacuagcggcuaaugcuaucuguucagcugucccaguugauuggguuccaaccagccgcacaaccuggucaauccaugcucaccaucaauggaugacaacagaagauauguuaucaguguggaauaggguuuggauagaggaaaacccauggauggaggauaaaacucauguauccagcugggaagaagucccauacuuagggaaaagggaagaucaaugguguggauccuugauaggcuugacagcgagggccacuugggccacuaacauacaaguagccauaaaccaagugagaaggcucaucggaaaugagaauuaucuagauuacaugacaucaaugaagagauucaagaaugagagugaucccgaaggggcacucugguaa

SEQ ID NO: 5574 - RNA, 9879 nt, Artificial Sequence
  derived and/or modified CDS sequence (wt) from DENV-1__FJ205874__SS-prME
uccgugaccaugcuccucaugcugcugcccacaguccuggcuuuccauuugaccacacgagggggagagccacacaugauaguugguaagcaggaaagaggaaagucacucuuguucaagaccucugcaggugucaauaugugcacucucaucgcgauggauuugggagaguugugugaggacacaaugacuuacaaaugcccccggaucacugaggcggaaccagaugacguugacugcuggugcaaugccacagacacaugggugaccuaugggacguguucucaaaccggugaacaccgacgagacaaacguuccguggcacuggccccacacgugggacuuggucuagaaacaagaacugaaacauggauguccucagaaggcgccuggaaacaaauacaaaaaguggagacuugggcuuugagacauccaggauucacggugauagcuuuuuuuuuagcacaugccauaggaacauccaucacucagaaagggaucauuuucauucugcugaugcugguaacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaauugugcauugaagcuaaaauaucaaacaccaccaccgauucaagauguccaacacaaggagaggcuacacuaguggaagaacaagacgcgaacuuugugugucgacgaacguuuguggacagaggcuggggcaauggcugcggacuauuuggaaaaggaagccuacugacgugugcuaaguucaagugugugacaaaacuggaaggaaagauaguucaauaugaaaacuuaaaauauucagugauagucacuguccacacaggggaccagcaccaggugggaaacgagacuacagaacauggaacaauugcaaccauaacaccucaagcuccuacgucggaaauacagcugaccgacuacggagcccucacacuggacugcucacccagaacagggcuggacuuuaaugagauggugcuauugacaaugaaagaaaaaucauggcuuguccacaaacaaugguuucuagacuuaccacugccuuggacuucgggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaaagggaugucauaugugaugugcacaggcucauuuaagcuagagaaggaaguggcugagacccagcaugggacuguucuagugcagguuaaauacgaaggaacagaugcgccauguaagaucccccuuucgacccaagaugagaaaggagugacccagaaugggagauugauaacagccaaucccauaguuacugacaaagaaaaaccagucaacauugagacagaaccaccuuuuggugagagcuacaucauaguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacgucugugggaaaauugguacaccagguuuuuggaaccgcauacgggguccuguucagcggcguuucuuggaccaugaaaauaggaauagggauccugcugacaugguugggauuaaauucaaggagcgcgucgcuuucgaugacgugcauugcaguuggcaugguuacacuguaccuaggagucaugguucaagcggacucgggauguguaaucaacuggaagggcagagaacucaaguguggaaguggcauuuuugucacuaaugaaguccacacuuggacagagcaauacaaauuccaagcugacuccccaaaaagacugucagcagccauugggaaggcaugggaggagggcguguguggaguucgaucagccacgcgucuugagaauaucauguggaagcaaauaucaaaugaauugaaccacauucuacucgaaaaugacaugaaauucacagugguuguaggagaugcuaauggaauuuuggcccaggggaaaaaaaugaucaggccacaacccauggaacacaaauacucauggaaaagcuggggaaaagccaagaucauaggagcagacauacagaauaccaccuucaucaucgacggcccagacacuccagaaugccccgaugaccaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggagguuagcgagagccuccuucauagaagucaagacaugcauuuggccgaaaucccacacucuauggaguaauggaguuuuggaaagugaaaugauaaucccaaagauauauggaggaccaauaucucagcacaauuacagaccaggguauuucacacaaacagcagggccauggcaucuaggcaaguuggaauuggauuuugacuugugugaaggcaccacaguuguuguggaugaacauuguggaaaucgagguccaucucucagaacuacaacagucacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauugggaauauuaugcuuaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucugacaggauggggaugggaacaacguaccuagccuugauggcuacuuucaaaaugagaccaauguucgccguuggguuauuauuucgcagacuaacauccagagagguucuucuucucacgauuggauuaagccugguggcauccguggagcuaccaaauucuuuggaggagcuaggggauggacuugcaaugggcaucaugauguuaaaacuauugaccgaauuucagccacaccaguuauggaccaccuuacugucucugacauuuaucaaaacaacucuuucauuggauuaugcauggaagacaauggcuaugguacugucaaucguaucucucuuuccuuuaugucugucuacgaccucccaaaagacaacauggcuuccggugcuguuaggaucuuuuggaugcaaaccauuaaccauguuucucauaacagaaaacaaaaucuggggaaggaaaaguuggccccucaaugaaggaauuauggccauuggaauagucagcauucugcuaaguucacuccucaaaaaugaugugccguuggccggcccacuaauagcuggaggcaugcuaauagcauguuaugucauauccggaagcucagccgaucuaucauuggagaaagcggcugagguauccugggaagaagaagcagaacacuccgguaccucacacaacauauuaguagagguccaagaugauggaacuaugaaaauaaaagaugaagagagggaugacacacucaccauccuccucaaagcaacucugcuggcaguuucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuauugggcaggucccaagugggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacucccgaaggugaaguuggagccguagcucuagauuuuaaacccggcacaucuggaucucccauugugaacagagagggaaaaauaguaggucuuuauggaaauggaguggugacaacaaguggaaccuacgucagugcuauugcccaagcuaaagcaucacaagaagggccccuaccagagauugaggacgagguguuuaagaaaagaaacuuaacaauaauggaccugcauccaggaucaggaaaaacaagaagauaucuuccagccauaguccgugaggccauaaaaaggaaacugcgcacguuaaucuuggcucccacaagaguugucgccucugaaauggcagaagcgcucaagggaaugccaauaagauaucagacaacagcagugaagagugagcacacaggaagggagauaguugaucucaugugccacgccacuuuuaccaugcgucucuuaucuccagugagaguucccaauuacaacaugauuaucauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaagaaagagacauuccugagagaucauggagcucaggcuacgauuggaucacugauuuuccagguaaaacagucugguuuguuccaagcauuaaaucaggaaaugacauugccaacuguuuaagaaagaacggaaaacgggugauccaauugagcagaaaaaccuuugacaccgaguaccagaaaacaaaaaacaaugacugggacuauguugucacaacagacauuuccgaaaugggagcaaauuucagggccgacaggguaauagacccaaggcggugcuugaaaccgguaauacuaaaagaugguccagagcgcgucauuuuagcuggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaacauaaacacaccagaagggaucaucccagcccucuuugagccagagagagaaaagagcgcagcaauagacggggaguacagacugcggggagaagcaaggaaaacguucguggagcucaugaaaagaggagaucuaccaguuuggcuauccuacaaaguugccucagaagguuuucaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguucaaagaguuugcagcaggaagaagaagugucucaggugaccuaaucuuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugaugcuguucuuccuaucaggaaaaggucuagggaaaacauccaucggccugcucugugugauggccucaagcgcacuguuauggauggccaguguggagccccauuggauagcggccuccaucauacuagaguucuuucuaauggugcugcucauuccagagccagacagacagcgcacuccacaggacaaccagcuagcguauguagugauagguuuguuauucaugauacugacaguggcagccaaugagaugggauuauuggaaaccacaaagaaagaccuggggauuggccauguagccgccgaaaaccaccaccacguuacaaugcuggacguagaccuacguccagcuucagccuggacccucuaugcgguagccacaacaguuaucacucccaugaugagacacacaauugaaaauacaacagcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcggugcugauguuaguggcucauuaugccauaauuggaccaggacugcaagcaaaggccacuagagaagcucaaaaaaggacagcggccggaauaaugaaaaauccaaccguagaugggauuguugcaauagacuuggauccugugguuuaugaugcaaaauuugaaaaacaacuaggccaaauaauguuacugauacuuuguacaucacagauucucuugaugcggaccacaugggccuugugugaguccaucacacuggcuacuggacccuugaccacucucugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagaucugaagccaaagagggauugaaaagaggagaaacaaccaaacaugcagugucgagaggaacagccaaacugaggugguuuguggagaggaaccuugugaaaccagaagggaaagucauagaucucgguuguggaagagguggcuggucauauuauugugcugggcugaagaaagucacugaagugaagggauacacaaaaggaggaccugggcaugaggaaccuaucccaauggcgacuuauggauggaaccuaguaaagcuacacucuggaaaagauguauuuuuuacaccaccugagaaaugugauacccuucugugugauauuggugaguccucuccgaauccaacuauagaagaaggaagaacguuacguguucuaaagaugguggaaccauggcuuagaggaaaccaauuuugcauaaaaauccuaaauccuuauaugccaagugugguagaaacucuggagcaaaugcaaaggagacauggagggaugcuagugagaaacccacucucaagaaauuccacccaugaaauguacuggguuucauguggaacaggaaacauugugucggcagugaacaugacauccagaauguuacugaaucgauucacaauggcgcauaggaagccaacauaugaaagagacguggacuuaggcgcuggaacaagacauguggcaguggaaccagagguagccaaccuagguaucauuggccagagaauagagaauauaaaaaaugaacacaagucaacauggcauuaugaugaagacaauccauacaaaacaugggccuaucauggaucauaugaggucaagccaucaggaucagccucaucuauggugaauggcguggugagauugcucacaaaaccaugggauguuauccccauggucacacaaauagcuaugacugauaccacacccuucggacaacagagaguguuuaaagagaaaguugauacgcgcacaccaagagcaaaacgaggcacagcacaaauuauggaggugacagccaaaugguuaugggauuuccuuuccagaaacaaaaaacccagaaucugcacaagagaggaguucauaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugcgccacgugugucuacaacaugauggggaagagagagaaaaaauuaggagaguuuggaaaggcaaaaggaagucgugcaauaugguacauguggcugggagcacgcuuucuagaguucgaagcccuugguuucaugaaugaagaucacugguucaguagagagaauucacucaguggaguggaaggagaaggacugcacaaacuuggauacauacucagagacauaucaaagauuccggggggaaacauguaugcagaugauacagccggaugggacacaagaauaacagaggaugaucuucagaaugaggcuaaaaucacugacaucauggagccugaacaugcucuauuggcuacgucaauuuuuaagcuaaccuaccaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaacuagaaaccacuaaucuagcugagagaguucuugacugguuggaaaaacauggugucgaaaggcugaaaagaauggcaauuaguggagaugauuguguggugaaaccaauugaugacagguucgcaacagccuuaauagcucugaaugacaugggaaaaguaagaaaagacauaccgcagugggaacccucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauacgcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauagggucuggauagaggaaaacccauggauggaggacaaaacucauguauccaguugggaagaaguuccauaccuagggaaaagggaagaucaaugguguggaucucugauaggcuugacagcgagggccaccugggccaccaacauacaaguagccauaaaccaagugagaaggcucauugggaaugagaauuaucuagauuacaugacaucaaugaagagauucaagaaugagagugaucccgaaggggcacucugguaa

SEQ ID NO: 5575 - RNA, 9879 nt, Artificial Sequence
  derived and/or modified CDS sequence (wt) from DENV-1__FJ205875__SS-prME
ucugugaccaugcuccucaugcugcugcccacagcccuggcguuccauuugaccacacgagggggagagccacacaugauaguuagcaagcaggaaagaggaaagucacuguuguuuaagaccucugcaggcaucaauaugugcacucucauugcgauggauuugggagaguuaugcgaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggugccuggaaacaaauacaaaaaguggagacuugggcuuugagacacccaggauucacggugauagcccuuuuuuuagcacaugccauaggaacauccauuacucagaaagggaucauuuucauuuuguugaugcuaguaacaccaucaauggccaugcgauguguaggaauaggcaacagagacuucguugaaggacugucaggagcaacguggguggacgugguauuggagcauggaagcugcgucaccaccauggcaaaagauaaaccaacauuggacauugaacucuugaagacggaggucacgaacccugccaucuugcgcaaacugugcauugaagcuaaaauaucaaacaccaccaccgauucaagguguccaacacaaggagaggcuacacugguggaagaacaagacgcgaacuuugugugucgacgaacguuuguggacagaggcugggguaauggcugcggacuauuuggaaaaggaagccuacugacgugugcuaaguucaagugugugacaaaacuagaaggaaagauaguucaguaugaaaacuuaaaauauucagugauagucacuguccacacuggggaccagcaccaggugggaaacgagacuacagaacauggaacaauugcaacuauaacaccucaagcuccuacgucggaaauacagcugacugacuacggagcccucacauuggacugcucaccuagaacaggguuggacuucaaugagauggugcuauugacaaugaaagaaaaaucauggcuuguccacaaacaaugguuucuagacuuaccacugccuuggacuucgggagcuucaacaucucaagagaccuggaacagacaagauuugcuggucacauucaagacagcucaugcaaagaaacaggaaguagucguacugggaucacaggaaggagcaaugcacacugcguugacuggggcgacagaaauucagacgucaggaacgacaacaaucuuugcaggacaccugaaaugcagacuaaaaauggauaaacugacuuuaaaagggaugucauauguaaugugcacaggcucauuuaagcuagagaaggaaguggcugagacccagcauggaacuguucuagugcagguuaaauacgaaggaacagaugcgccaugcaagaucccuuuuucgacccaagaugagaaaggagugacccagaaugggagauugauaacagccaaccccauagucacugacaaagaaaaaccaguuaacauugagacagaaccaccuuuuggugagagcuacaucgugguaggggcaggugaaaaagcuuugaaacugagcugguucaagaaagggagcagcauagggaaaauguucgaagcaaccgcccgaggagcacgaaggauggcuauccugggagacaccgcaugggacuuuggcucuauaggaggaguguucacgucagugggaaaauugguacaccagguuuuuggaaccgcauaugggguucuguucagcgguguuucuuggaccaugaaaauaggaauagggauucugcugacaugguugggauuaaauucaaggagcacgucacuuucgaugacgugcauugcgguuggcauggucacacuguaccuaggagucaugguucaagcggacucgggauguguaaucaacuggaagggcagagaacucaaauguggaagugguauuuuugucacuaaugaaguccacacuuggacagagcaauacaaauuccaggcugacuccccaaaaagacugucagcagccauugggaaggcaugggaggagggcguguguggaauucgaucagccacgcgucuugagaacaucauguggaagcaaauaucaaaugaguugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagccaaaaucauaggagcagacauacagaauaccaccuucaucaucgacggcccagacacuccagaaugccccgaugaccaaagagcguggaacauuugggaaguugaggacuauggguuuggaauuuucacgacaaacauauggcugaaauugcgcgacuccuacacccaaaugugugaccaccggcuaaugucagcugccaucaaggacagcaaggcaguccaugcugacaugggauacuggauagaaagugaaaagaacgagaccuggaagcuagcgagagccuccuucauagaagucaagacaugcaucuggccgaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacgcuucagaggagaagacggauguugguauggcauggaaauuagaccaguuaaggagaaggaggaaaaccuaguuaggucaauggucucugcagggucaggagaaguggacaguuuuucacuagggauacuaugcguaucaauaaugauugaagaagugaugagauccagauggaguaaaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuugccuugauggcuacuuucaaaaugagaccaauguucgcuguugggcuauuauuucgcagacuaacauccagagaaguucuucuucucacgauuggauuaagccugguggcauccguggaguuaccaaauucuuuggaggagcuaggggauggacuugcaauggguaucaugauguuaaaauuauugacugaauuucagccacaccaguuguggaccaccuuacugucuuugacauuuaucaaaacaacucuuucauuggauuaugcauggaggacaauggcuauggugcugucaaucguaucucucuuuccuuugugucuguccacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuuaaaaaugaugugccguuagccggcccacuaauagcuggagguaugcuaauagcauguuaugucauauccggaagcucagccgauuuaucauuggagaaagcggcugagguauccugggaagaagaagcagaacacucugguaccucacacaacauauuaguagagguccaagaugauggaacuaugaaaauaaaagaugaagagagggaugacacacuuaccauacuccucaaagcaacucugcuggcaguuucaggaguguacccaaugucaauaccagcaacucuuuucgugugguauuuuuggcagaaaaagaaacagagaucaggaguguuaugggacacacccagcccuccggaaguggaaagagcaguucuugaugauggcaucuauagaauccugcaaagaggacuguugggcaggucccaagugggagugggaguuuuucaagacggcguguuccacacaauguggcacgucaccaggggagcuguccuuauguaccaagggaagagguuggaaccaagcugggccagugucaaaaaggacuugaucucauauggaggagguuggagguuccaaggaucauggagcacgggagaagaagugcaggugauagcuguugaaccaggaaaaaaucccaaaaauguacagacaacgccggguaccuucaagacucccgaaggcgaaguuggagccauagcucuagauuuuaaacccggcacaucuggaucucccaucgugaacagagaggggaaaauaguaggucuuuauggaaauggaguggugacaacaaguggaaccuacgucagugccauugcccaagcuaaaacaucacaagaagggccucuaccagagauugaggacgagguguuuaagaaaaggaacuuaacaauaauggaccugcauccaggaucaggaaaaacaagaagauaucuaccagccauaguccgugaggccauaaaaaggaaacugcgcacauuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacaaagcaaugcaguuauccaagaugaggaaagagacauuccugagagaucauggaacucaggcuacgacuggaucacugauuuuccagguaaaacagucugguuuguuccaagcauuaaaucaggaaaugacauugcuaacuguuugagaaagaacggaaaacgggugauccaauugagcagaaaaaccuuugacacugaguaccagaaaacaaaaaacaaugacugggacuauguugucacaacagacauuuccgaaaugggggcaaauuuccgggccgacaggguaauagacccaaggcgaugcuugaaaccagugauacuaaaagaugguccagagcgugucauucuagccggaccgaugccagugacuguggccagugcugcccagagaagaggaagaauuggaaggaaccaaaacaaggaaggugaucaguacguuuacaugggacagccuuuaaauaaugaugaggaucacgcucauuggacagaagcaaaaaugcuccuugacaauauaaacacaccagaagggaucauuccagcccucuuugagccagagagagaaaagagugcagcaauagauggggaguacagacugcggggagaagcaaggaaaacguucguggagcucaugagaagaggagaucuaccaguuuggcuauccuacaaaguugccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccuucgugaguucaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaagaacuaccagacaccauagaaacauugaugcuccuagcucugauagcugugcugacugguggagugacgcuguucuuccuaucaggaaaaggucuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggacaaccagcuagcauacguggugauagguuuguuauucaugauacugacaguggcagccaaugagaugggacuauuggaaaccacaaagaaagaccuggggauuggccauguagccgccgaaaaccaccaccaugccacgaugcuggacguagaccuacgcccagcuucagccuggacccucuaugcaguagccacaacagucaucacucccaugaugagacacacaauugaaaauacaacggcaaacauuucccugacagccauugcaaaccaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccuguggucuaugaugcaaaguuugaaaaacagcuaggccaaauaauguuacugauacuuuguacaucacagauucucuugaugcggaccacaugggccuugugugaauccaucacacuggccacuggacccuugaccacucucugggagggaucuccaggaaaauucuggaauaccacgauagcaguguccauggcaaacaucuucaggggaaguuaucuagcaggagcuggucuggccuucucguuaaugaaaucucuaggaggaggcaggagagguacgggggcucaaggagaaacacugggagagaaauggaaaagacaguuaaaccaacugagcaagucagaauuuaacaccuacaaaaggagugggauuauggagguggacagauccgaagccaaagagggauuaaaaagaggagaaacaaccaaacaugcagugucgagagguacagccaaacugagguggcuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaaacuauacucuggaaaagauguauuuuuuacaccaccugagaaaugugauacccuuuugugugauauuggagaguccucuccgaauccaacuauagaagaaggaagaacguuacguguuuuaaagaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaauaugacauccagaauguuacugaaucgauucacaaugguucacaggaagccaacauaugaaagagacguggacuuaggcgcuggaacaagacacguggcaguggaaccagagguagccaaccuagauaucauuggccagaggauagagaauauaaaaaaugaacacaagucaacauggcauuaugaugaagacaauccauacaaaacaugggccuaucauggaucauaugaggucaaaccaucaggaucagccucaucuauggugaauggcguggugagacugcucacaaaaccaugggaugucauccccauggucacacaaauagccaugacugauaccacacccuucggacaacagagaguguuuaaagagaaaguugacacgcgcacaccaagagcaaaacgaggcacagcacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuagaguucgaagcccuugguuucaugaaugaagaucacugguucaguagagagaauucauucaguggaguggagggagacggacugcacaaacuuggauacauacuccgagacauaucaaagauuccggggggaaauauguaugcagaugacacagccggaugggacacaagaauaacagaggaugaucuucagaaugaggcuaaaaucacugacaucauggagccugaacacgcccuauuggcuacgucaauuuuuaagcugaccuaccaaaacaaggugguaagggugcaaagaccagcaaaaaauggaaccgugauggauguuauauccagacgagaccagagaggaagugggcaggucggaaccuacggcuuaaauacuuucacaaauauggaggcccaacuaauaagacaaauggagucugaaggaaucuuucuacccagcgaauuggaaacccccaaucuagcugagagaguucuugacugguuggaaaaacauggcaccgaaaggcugaaaagaauggcaauuagcggagaugauuguguggugaaaccaguugaugauagguuugcaacagccuuaacagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaaugcuaucuguucagcugucccaguugacugggucccaaccagccgcacaaccuggucaauccaugcucaccaucaauggaugacaacagaagacaugcuaucaguguggaauaggguuuggauagaggaaaacccauggauggaggacaaaacucauguauccagcugggaagaaguuccauacuuagggaaaagagaagaucaaugguguggaucccugauaggcuugacagcaagggccacuugggccacuaacauacaaguggccauaaaccaggugagaaggcucaucgggaaugagaauuaucuagauuacaugacaucaaugaagagguuuaagaacgagagugaucccgaaggggcacucugguaa

SEQ ID NO: 5576 - RNA, 9879 nt, Artificial Sequence
  derived and/or modified CDS sequence (wt) from DENV-1__FJ410173__SS-prME
ucugugaccaugcuccucaugcuguugcccacagcccuggcguuccauuugaccacacgagggggagagccacacaugauaguuaguaagcaggaaagaggaaagucacuguuguuuaagaccucugcaggcaucaauaugugcacucucauugcgauggauuugggagaguuaugugaggacacaaugaccuacaaaugcccccggaucacugaggcggaaccagaugacguugacugcuggugcaaugccacagacacaugggugaccuaugggacauguucucaaaccggcgaacaccgacgagacaaacguuccguggcacuggccccacacgugggacuuggucuagaaacaagaaccgaaacauggauguccucugaaggugccuggaaacaaauacaaaaaguggagacuugggcuuugagacacccaggauucacggugacagcccuuuuuuuagcacaugccauaggaacauccauuacucagaaagggaucauuuucauuuugcugaugcuaguaacaccaucaauggccaugcgauguguaggaauaggcaacagggacuucguugaaggacugucaggagcaacguggguggacgugguauuggagcauggaagcugcgucaccaccauggcaaaagauaaaccaacauuggacauugaacucuugaagacggaggucacaaacccugccgucuugcgcaaacugugcauugaagcuaaaauaucaaacaccaccaccgauucaagguguccaacacaaggagaggccacacugguggaagaacaagacucgaacuuugugugucgacgaacguuuguggacagaggcugggguaauggcugcggacuauuuggaaaaggaagccuacugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcaacuauaacaccucaagcuccuacgacggaaauacagcugacugacuacggagcccucacauuggacugcucaccuagaacagggcuggacuuuaaugagaugguucuauugacaaugaaagaaaaaucauggcuuguccacaaacaaugguuucuagacuuaccacugccuuggacuucaggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacgaucuuugcaggacaccugaaaugcagacuaaaaauggauaaacugacuuuaaaagggaugucauauguaaugugcacaggcucauuuaagcuagagaaggaaguggcugagacccagcauggaacuguucuagugcagguuaaauacgaaggaacagaugcgccaugcaagaucccuuuuucggcccaagaugagaaaggagugacccagaaugggagauugauaacagccaaccccauagucacugacaaagaaaaaccagucaacauugagacagaaccaccuuuuggugagagcuacaucgugguaggggcaggugaaaaagcuuugaaacugagcugguucaagaaagggagcagcauagggaaaauguucgaagcaacugcccggggagcacgaaggauggcuauccugggagacaccgcaugggacuuuggcucuauaggaggaguguucacaucagugggaaaauugguacaccagguuuuuggagccgcauaugggguucuguucagcgguguuucuuggaccaugaaaauaggaauagggauucugcugacaugguugggauuaaauucaaggagcacgucacuuucgaugacgugcauugcgguuggcauggucacacuguaccuaggagucaugguucaagcggacucgggauguguaaucaacuggaaaggcagagaacucaaauguggaagugguauuuuugucaccaaugaaguccacacuuggacagagcaauacaaguuccaggcugacuccccaaaaagacugucagcagccauugggaaggcaugggaagagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaggggaaaaaaaugauuaggccacaacccauggaacauagauacucauggaaaagcuggggaaaagccaaaaucauaggagcagacauacagaauagcaccuucaucaucgacggcccagauacuccagaaugccccgaugaccaaagagcguggaacauuugggaaguugaagacuauggguuuggaauuuucacgacaaacauauggcugaaauugcgcgacuccuacacccaaaugugugaccaccggcuaauguccgcugccaucaaagacagcaaggcaguccaugcugacaugggguacuggauagaaagugaaaagaacgagaccuggaagcuagcgagagccuccuucauagaagucaagacauguaucuggccgaaaucccacacucuauggaguaauggaguuuuggaaagugaaaugauaaucccaaagauauauggaggaccaauaucucagcacaacuacagaccaggguauuucacacaaacagcaggaccauggcaccuaggcaaguuggaauuggauuuugacuugugugaagguaccacaguuguuguggaugaacauuguggaaaucgaggcccaucucucagaacuacaacagucacaggaaagauaauccaugaaugguguugcagauccugcacguuaccccccuuacgcuucagaggagaagacggauguugguauggcauggaaaucagaccaguuaaggagaaggaggaaaaccuaguuaggucaauggucucugcagggucaggagaaguggacaguuuuucacuagggauacuaugcguaucaauaaugauugaagaagugaugagauccagauggaguagaaagaugcugaugacuggaacauuggcuguuuuccuccuucuuauaaugggacaacugacauggaaugaccugauuagguuaugcaucaugguuggagcuaaugcuucagacaggauggggaugggaacaacguaccuggccuugauggcuacuuucaaaaugagaccaauguucgcuguugggcuacuauuucgcagacuaacauccagagaaguucuucuucucacgauuggauuaagccugguggcaucuguggaguuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuaugcauggaggacaauggccauggugcugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuuaaaaaugaugugccguuggccggcccacuaauagcuggaggcaugcuaauagcauguuaugucauauccggaagcucagccgauuuaucauuggagaaagcggcugagguauccugggaagaagaagcagaacacucugguaccucacacaacauauuaguagagguccaagaugauggaacuaugaaaauaaaggaugaagagagggaugacacacucaccauacuccucaaagcaacuuugcuggcagucucaggaguguacccaaugucaauaccagcaacuuuuuucgugugguauuuuuggcagaaaaagaaacagagaucaggaguguuaugggacacacccagcccuccggaaguggaaagagcaguucuugaugauggcaucuauagaauccugcaaagaggacuguugggcaggucccaaguaggagugggaguuuuccaggacggcguguuccacacaauguggcacgucaccaggggagcuguccuuauguaccaagggaagagguuagaaccaagcugggccagugucaaaaaggacuugaucucauauggaggagguuggagauuucaaggaucauggaacacgggagaagaggugcaggugauagccguugaaccaggaaaaaauccuaaaaauguacagacaacgccggguaccuucaagacucccgaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaagacaucacaagaagggccucuaccagagauugaggaggagguguuuaagaaaaggaacuuaacaauaauggaccugcauccaggaucgggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacucgaguggguaugggugaagcagcugcgaucuuuaugacagccacucccccaggaucgguggaggccuuuccacaaaguaaugcaguuauccaagaugaggaaagagacauuccugagagaucauggaacucaggcuacgacuggaucacugauuuuccagguaaaacagucugguuuguuccaagcauuaagucaggaaaugacauugcuaacuguuuaagaaagaacggaaaacgggugauccaauugagcagaaaaaccuuugacacugaguaccagaaaacaagaaacaaugacugggacuauguugucacaacagacauuuccgaaaugggggcaaauuuccgggccgacaggguaauagacccaaggcggugcuugaaaccagugauacuaaaagaugguccagagcgugucauucuagccggaccgaugccagugacuguggccagugcugcccagagaagaggaagaauuggaaggaaccaaaacaaggaaggugaucaguacguuuauaugggacagccuuuaaauaaugaugaggaucacgcucauuggacagaagcaaaaaugcuccuugacaauauaaacacaccagaagggaucauuccagcccucuuugagccagagagagaaaagagugcagcaauagauggggaguacagacugcggggagaagcaaggaaaacguucguggagcucaugagaagaggagaucuaccaguuuggcuauccuacaaaguugccucagaagguuuccaguacuccgacagaagguggugcuuugacggggaaaggaacaaccagguguuggaggagaacauggacguggagaucuggacaaaggaaggagaaaggaagaaauugcgaccccgcugguuggaugccagaacauacucugauccacuggcccuucgugaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggacaaccagcuagcauacguggugauagguuuguuauucaugauacugacaguggcagccaaugagaugggauuauuggaaaccacaaagaaagaccuggggauuggccauguagccgccgaaaaccaacaucaugccacgaugcuggacguagaccuacgcccagcuucagccuggacccucuaugcaguggccacaacaguuaucacucccaugaugagacacacaauugaaaacacaacagcaaacauuucccugacagccauugcaaaccaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaguuaggccaaauaauguuacugauacuuuguacaucacagauucucuugaugcggaccacaugggcccugugugaauccaucacacuggcuacuggacccuugaccacucucugggagggaucuccaggaaaauucuggaauaccacgauagcaguguccauggcaaacaucuucaggggaaguuaucuagcaggagcaggucuggccuucucguuaaugaaaucuuugggaggaggcaggagagguacgggggcucaaggagaaacacugggagagaaauggaaaagacaguuaaaccaacugagcaagucagaauucaacaccuacaaaaggagugggauuauggagguggacagauccgaagccaaagagggauuaaaaagaggagagacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagucaagggauacacaaaaggaggaccuggacaugaggaaccuaucccaauggcgaccuauggauggaaccuaguaaagcuauacucuggaaaagauguauuuuuuacaccaccugagaaaugugauacccuucugugugauauaggagaguccucuccgaauccaacuauagaagaaggaagaacguuacguguucuaaagaugguagaaccauggcucagaggaaaccaauucugcauaaaaauucuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaaugacucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaagacaauccauacaaaacaugggccuaucauggaucauaugaggucaaaccaucaggaucagccucaucuauggugaauggcguggugagauugcucacaaaaccaugggaugucauccccauggucacacaaauagccaugaccgauaccacacccuucggacaacagagaguguuuaaagagaaaguagauacgcgcacgccgagagcaaaacgaggcacagcacaaauuauggaggugacagccaaguggcuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggaacuucauaaacagggaaaaugugccacgugugucuacaacaugauggggaagagagagaaaaaauugggagaguuuggaaaggcaaaaggaagucgugcaauaugguacauguggcugggagcacgcuuucuagaguucgaagcccuugguuucaugaaugaagaucacugguucaguagagagaauucauucaguggaguggaaggagaaggacugcacaaacuuggauacauacucagagacauaucaaagaucccggggggaaacauguaugcagaugacacagccggaugggacacaagaauaacagaggaugaucuucagaaugaggccaaaaucacugacaucauggagccugaacacgcucuauuagcuacgucaauuuuuaagcugaccuaccaaaacaaggugguaagggugcaaagaccagcaaaaaauggaaccgugauggauguuauauccagacgagaccagagaggaagugggcaggucggaaccuauggcuuaaauacuuucaccaauauggagguccaacuaauaagacaaauggagucugaaggaaucuuuuuacccagcgaauuggaaacccccaaucuagcugagagaguucuuaacugguuggaaaaacauggcacugaaaggcugaaaagaauggcaauuagcggagaugauuguguggugaaaccaguugaugacagguuugcaacagccuuaauagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccuaagacuagcggcuaaugcuaucuguucagcugucccaguugacuggguuccaaccagccgcacaaccuggucaauccaugcucaccaucaauggaugacaacagaagauauguuaucaguguggaauaggguuuggauagaggaaaacccauggauggaggauaaaacucauguauccagcugggaagaagucccauacuuagggaaaagggaagaucaaugguguggaucccugauaggcuugacagcgagggccacuugggccacuaacauacaaguagccauaaaccaagugagaaggcucaucggaaaugagaauuaucuagauuacaugacaucaaugaagagauucaagaaugagagugaucccgaaggggcacucugguaa
